United States Patent
Gupta et al.

(10) Patent No.: US 9,206,429 B2
(45) Date of Patent: Dec. 8, 2015

(54) APTAMERS THAT BIND TO IL-6 AND THEIR USE IN TREATING OR DIAGNOSING IL-6 MEDIATED CONDITIONS

(71) Applicants: SomaLogic, Inc., Boulder, CO (US); Otsuka Pharmaceutical Co., Ltd., Osaka (JP)

(72) Inventors: Shashi Gupta, Louisville, CO (US); Masao Hirota, Osaka (JP); Daniel J. Schneider, Arvada, CO (US); Tomoki Suzuki, Osaka (JP); Thale C. Jarvis, Boulder, CO (US); Yuichi Ishikawa, Osaka (JP); Ikuo Murakami, Osaka (JP); Amy Gelinas, Boulder, CO (US); Sheela Waugh, Erie, CO (US); Nebojsa Janjic, Boulder, CO (US)

(73) Assignees: SomaLogic, Inc., Boulder, CO (US); Otsuka Pharmaceutical Co., Ltd, Tokyo (JP)

(*) Notice: Subject to any disclaimer, the term of this patent is extended or adjusted under 35 U.S.C. 154(b) by 0 days.

(21) Appl. No.: 14/206,814

(22) Filed: Mar. 12, 2014

(65) Prior Publication Data

US 2014/0315986 A1  Oct. 23, 2014

Related U.S. Application Data

(60) Provisional application No. 61/782,938, filed on Mar. 14, 2013, provisional application No. 61/789,244, filed on Mar. 15, 2013.

(51) Int. Cl.
 *C07H 21/04* (2006.01)
 *C12N 15/115* (2010.01)

(52) U.S. Cl.
 CPC .......... *C12N 15/115* (2013.01); *C12N 2310/16* (2013.01)

(58) Field of Classification Search
 None
 See application file for complete search history.

(56) References Cited

U.S. PATENT DOCUMENTS

| | | |
|---|---|---|
| 2010/0055695 A1 | 3/2010 | Zichi et al. |
| 2012/0135540 A1 | 5/2012 | Bruno |
| 2013/0012693 A1 | 1/2013 | Schneider et al. |

FOREIGN PATENT DOCUMENTS

| | | |
|---|---|---|
| WO | 2013021284 A2 | 2/2013 |

OTHER PUBLICATIONS

International Search Report and Written Opinion of the International Search Authority for PCT/US14/24699 date of mailing of Sep. 25, 2014.
Kim M, et al., "In vitro selection of DNA aptamers binding to the recombinant human interleukin-6," Mol. Cells, 1995, 5(6):555-562.
King DJ, et al. "Novel combinatorial selection of phosphorothioate oligonucleotide aptamers," Biochemistry. Nov. 24, 1998;37(47):16489-93.
Meyer C, et al. "Interleukin-6 receptor specific RNA aptamers for cargo delivery into target cells," RNA Biol. Jan. 2012;9(1):67-80. Epub Jan. 1, 2012.

*Primary Examiner* — Kimberly Chong
(74) *Attorney, Agent, or Firm* — McNeill Baur PLLC

(57) ABSTRACT

Aptamers that bind IL-6 are provided. Pharmaceutical compositions comprising IL-6 aptamers are provided, as well as methods of treating conditions using the aptamers are also provided.

11 Claims, 20 Drawing Sheets

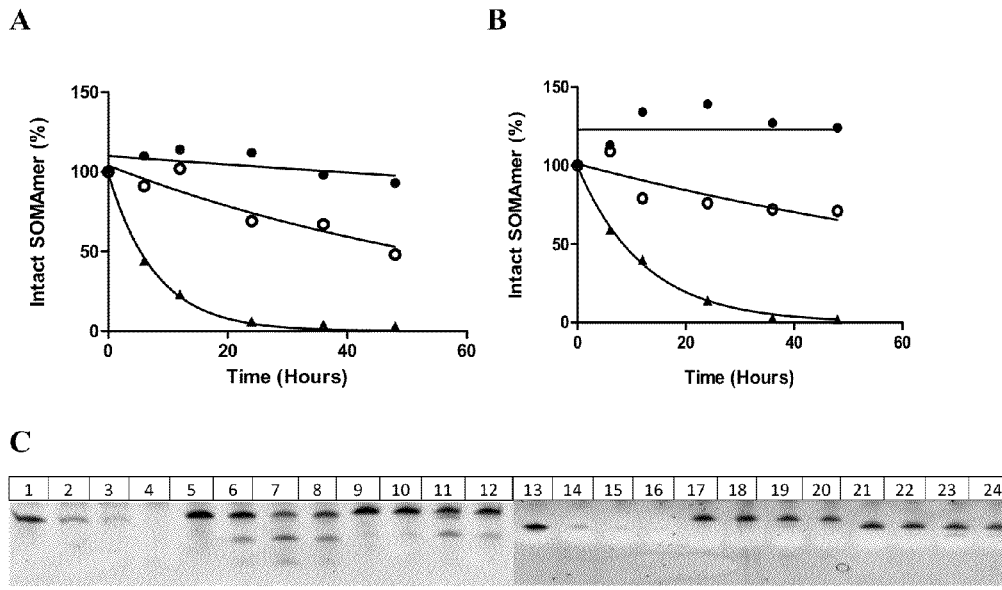

Lane 1: 2573-20_116 (SEQ ID NO: 300) - no serum exposure
Lane 2: 2573-20_116 (SEQ ID NO: 300) - exposed to human serum for 24 hours
Lane 3: 2573-20_116 (SEQ ID NO: 300) - exposed to rat serum for 24 hours
Lane 4: 2573-20_116 (SEQ ID NO: 300) - exposed to monkey serum for 24 hours
Lane 5: 2573-20_15 (SEQ ID NO: 22) - no serum exposure
Lane 6: 2573-20_15 (SEQ ID NO: 22) - exposed to human serum for 24 hours
Lane 7: 2573-20_15 (SEQ ID NO: 22) - exposed to rat serum for 24 hours
Lane 8: 2573-20_15 (SEQ ID NO: 22) - exposed to monkey serum for 24 hours
Lane 9: 2573-20_136 (SEQ ID NO: 101) - no serum exposure
Lane 10: 2573-20_136 (SEQ ID NO: 101) - exposed to human serum for 24 hours
Lane 11: 2573-20_136 (SEQ ID NO: 101) - exposed to rat serum for 24 hours
Lane 12: 2573-20_136 (SEQ ID NO: 101) - exposed to monkey serum for 24 hours Lane 13: 2574-49_456 (SEQ ID NO: 572) - no serum exposure
Lane 14: 2574-49_456 (SEQ ID NO: 572) - exposed to human serum for 24 hours
Lane 15: 2574-49_456 (SEQ ID NO: 572) - exposed to rat serum for 24 hours
Lane 16: 2574-49_456 (SEQ ID NO: 572) - exposed to monkey serum for 24 hours
Lane 17: 2574-49_14 (SEQ ID NO: 35) - no serum exposure
Lane 18: 2574-49_14 (SEQ ID NO: 35) - exposed to human serum for 24 hours
Lane 19: 2574-49_14 (SEQ ID NO: 35) - exposed to rat serum for 24 hours
Lane 20: 2574-49_14 (SEQ ID NO: 35) - exposed to monkey serum for 24 hours
Lane 21: 2574-49_260 (SEQ ID NO: 400) - no serum exposure
Lane 22: 2574-49_260 (SEQ ID NO: 400) - exposed to human serum for 24 hours
Lane 23: 2574-49_260 (SEQ ID NO: 400) - exposed to rat serum for 24 hours
Lane 24: 2574-49_260 (SEQ ID NO: 400) - exposed to monkey serum for 24 hours

*FIG. 8*

A
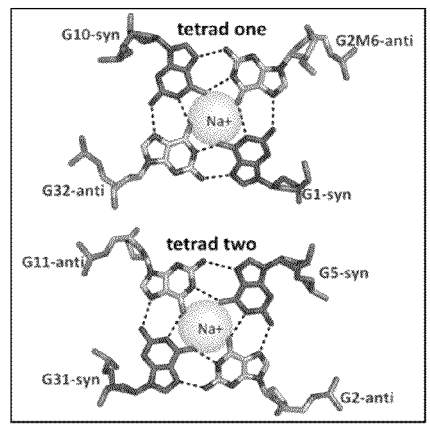
B
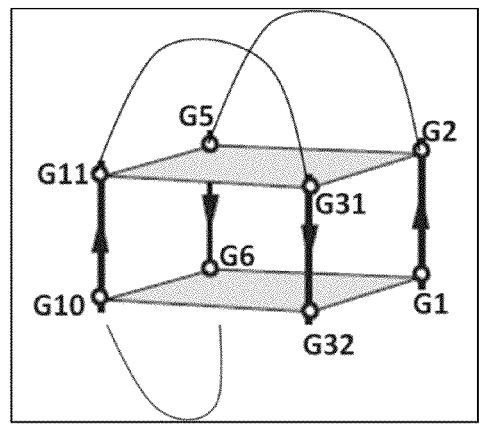
C
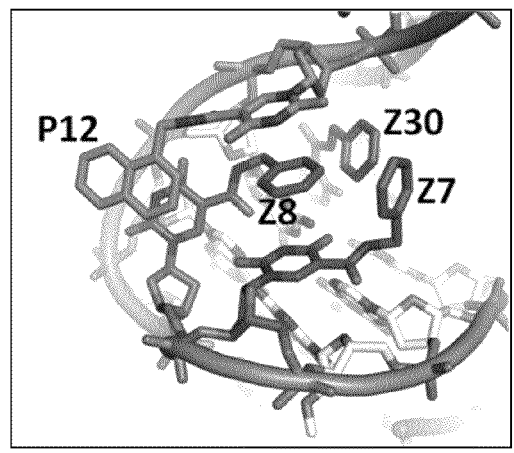
D
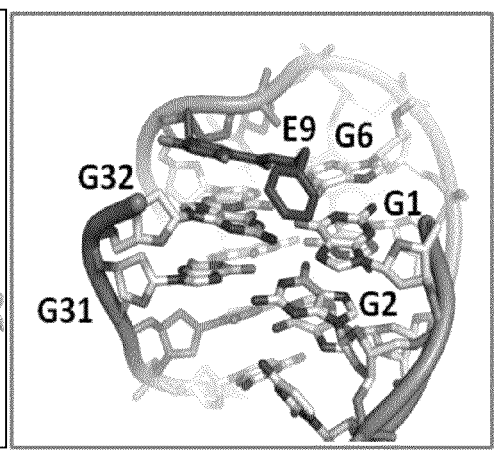
*FIG. 14*

Human IL-6 precursor sequence (Swiss-Prot Accession No. P05231.1)

```
MNSFSTSAFG  PVAFSLGLLL  VLPAAFPAPV  PPGEDSKDVA  APHRQPLTSS
ERIDKQIRYI  LDGISALRKE  TCNKSNMCES  SKEALAENNL  NLPKMAEKDG
CFQSGFNEET  CLVKIITGLL  EFEVYLEYLQ  NRFESSEEQA  RAVQMSTKVL
IQFLQKKAKN  LDAITTPDPT  TNASLLTKLQ  AQNQWLQDMT  THLILRSFKE
FLQSSLRALR  QM (SEQ ID NO: 9)
```

Human IL-6 mature sequence (amino acids 29 to 212 of Swiss-Prot Accession No. P05231.1)

```
PV  PPGEDSKDVA  APHRQPLTSS  ERIDKQIRYI  LDGISALRKE  TCNKSNMCES
SKEALAENNL  NLPKMAEKDG  CFQSGFNEET  CLVKIITGLL  EFEVYLEYLQ
NRFESSEEQA  RAVQMSTKVL  IQFLQKKAKN  LDAITTPDPT  TNASLLTKLQ
AQNQWLQDMT  THLILRSFKE  FLQSSLRALR  QM (SEQ ID NO: 10)
```

FIG. 21

| Mod | 5'dU | Code | BndU7 | BndU8 | PEdU9 | NapdU12 | BndU30 |
|---|---|---|---|---|---|---|---|
| NapdU | | P | 0.05 | >100 | 1.3 | 1.0 | 3.4 |
| iBudU | | I | >100 | >100 | 1.5 | >100 | 0.15 |
| TrpdU | | W | 0.35 | >100 | 0.82 | >100 | 2.4 |
| FBndU | | F | 4.2 | 1.3 | 1.4 | >100 | 1.2 |
| 2NapdU | | i | 0.57 | >100 | 0.65 | 1.2 | 0.73 |
| PEdU | | E | 0.84 | >100 | 1.0 | >100 | 2.5 |
| TyrdU | | Y | 3.8 | >100 | 1.6 | >100 | >100 |
| NEdU | | e | 0.45 | >100 | 0.8 | 2.5 | 1.3 |
| MBndU | | M | 0.01 | 0.71 | 1.3 | 1.1 | 2.9 |
| PPdU | | J | 1.8 | >100 | 1.2 | >100 | 1.3 |
| MOEdU | | n | >100 | >100 | 1.4 | >100 | >100 |
| BTdU | | s | 0.23 | 1.1 | >100 | 1.1 | >100 |
| BEdU | | f | 0.04 | >100 | 0.99 | >100 | 1.8 |
| RTHFdU | | f¹ | >100 | >100 | 1.3 | >100 | 2.5 |
| STHdU | | f² | >100 | >100 | 2.5 | >100 | 3.9 |

*FIG. 22*

| ID | Counts | SEQ ID NO 7 | | | | | | SEQ ID NO |
|---|---|---|---|---|---|---|---|---|
| 2573-20 | 922 | | | | | ZGGGCA | GGZZZGG | ZAZZAACACGZZAAGZCGZGGGGZCG |
| 2573-108 | 1 | | | | | CZ | GGZZZGG | CZCGCGGAZZZACAZAGGZGAAAGCZGGACC | 601
| 2573-103 | 1 | | | | | | GGZZZGG | ZGZZCGAZGGCZZZCGGAZACAGAGZCAC | 602
| | | | | | | | | SEQ ID NO |
| 2573-105 | 447 | ZACCCZGGZG | ZZGGGGZZAA | ZGZGGZZZG | C | | GGZZZGG | CAACAZ | 603
| 2573-100 | 217 | AAZGGAAZCZZCAGC | ZZGGGGZZAA | ZGZGGZZZG | G | | GGZZZGG | | 604
| 2573-117 | 37 | ACCGA | ZGGGGZZAA | ZGZGGZZZG | C | | GGZZZGG | CAZGGZACGC | 605
| 2573-99 | 3 | ZCAZGAG | ZGGGGZZAA | ZGZGGZZZG | ZC | | GGZZZGG | GAACGC | 606
| 2573-107 | 3 | G | CZGGGGZZAA | ZGZGGZZZG | C | | GGZZZGG | GAGGZCAZCGZGAZ | 607
| 2573-116 | 2 | GGZ | AZGGGGZZAA | ZGZGGZZZG | C | | GGZZZGG | GCGCZCGZGAZC | 608
| 2573-98 | 2 | ZCGGCC | CZGGGGZZAA | ZGZGGZZZG | G | | GGZZZGG | CAGZGGCZ | 609
| 2573-101 | 1 | ZACCCZGAZG | ZZGGGGZZAA | ZGZGGZZZG | G | | GGZZZGG | C |
| 2573-104 | 1 | AAZAGGAAGZCZZCAGCG | ZZGGZZZAA | G | ZGZGGGZZA | GG | GGZZZGG | | 610
| 2573-115 | 11 | | ZAA GGA | ZGZGGGZZZG | GCACGGGCA | | GGZZZGG | ZCZGZAGCCA |
| 2573-111 | 84 | | ZAAG | GCZZGG | GC | GGZAGCGG | GGZZZGG | GGAZGZGCZGCZCZZCA | 611
| 2573-109 | 34 | | ZAAG | ZCZZGG | CA | GGAGGGZAA | GGZZZGG | ZAZGGAGCGAA | 612
| 2573-113 | 16 | | ZZAG | AAZZGG | AGGG | GGAGCGAGGA | GGZZZGG | ZAZGZZCGG | 613
| 2573-102 | 5 | | ZZAG C | AAZZGG | GCCA | GGCGGGZGGA | GGZZZGG | ZGCGZCGG | 614
| 2573-106 | 1 | | GZGCG ZAAG | AGZZGG | CACG | GGZCZA | GGZZZGG | ZAZGZAGC | 615
| 2573-110 | 1 | | CZGZAZGZZA ZAZG | ZCCZGG | ZGC | GGZCZ | GGZZZGG | ZGZZZ | 616
| 2573-112 | 1 | | CCZCCGZGCZGCGAZGC ZAAA | AZZZZG | AAAA | GGC | GGZZZGG | | 617
| 2573-114 | 1 | | ZZAZGGGZGZGCGZZGGGAACAGGGC | | | | GGZZZGG | ZGCZGCA | 618

Z = BndU

*FIG. 23*

| Abbreviation | 5-dU Modification | Chemical Structure |
|---|---|---|
| Bn | benzylmethyl | 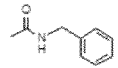 |
| Nap | *1*-naphthylmethyl | 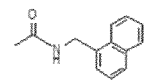 |
| PE | *2*-phenylethyl | 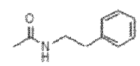 |
| PP | *3*-phenylpropyl | 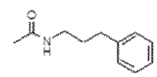 |
| Ib | *iso*-butyl | 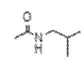 |
| FBn | *4*-fluorobenzylmethyl | 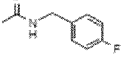 |
| 2Nap | *2*-naphthylmethyl | 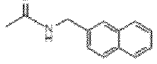 |
| Tyr | tyrosyl | 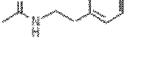 |
| NE | *1*-naphthylethyl | 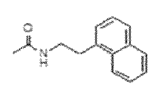 |
| MBn | 3,4-methylenedioxy benzyl | 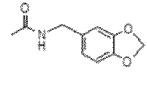 |
| MOE | morpholinoethyl | 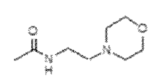 |
| BF | 3-benzofuranylethyl | 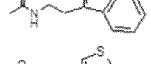 |
| BT | 3-benzothiophenylethyl | 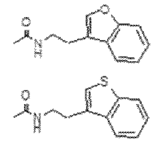 |
*FIG. 24*

| Seq ID | Counts | | | | | | SEQ ID NO |
|---|---|---|---|---|---|---|---|
| 2574-49 | 36 | AGPG | CGPAAGGCGGP | GGGCGAGGGAP-3' | PPAPGPPAG | CG | 8 |
| 2574-103 | 57 | AAGP | CGPAAGGCGGP | GPAGC-3' | PPAPGPPAG | CG | 619 |
| 2574-101 | 11 | GGAG | CGPAAGGCGGP | CGGAG-3' | PPAPGPPAG | ACG | 620 |
| 2574-104 | 20 | C | CGPAAGCCGGP | 5'-PGCGAGGGG | PPAPGPPAG | GAC | 621 |
| 2574-100 | 1 | P | CGPAAGGCGAP | AGPGPGCGCCCPCACGA | PPAPGPPAG | GGAGGAGCGGC | 622 |
| 2574-99 | 5 | | AGPAAGGCGGP | CCCCPGAA | PPAPGPPAG | CGAAGGPCPACP | 623 |
| 2574-97 | 1 | A | CGPAAGGCGGP | CCAAAGGGA | CPAPGPPAG | CGAGGAAPAACCAGCCP | 624 |
| 2574-98 | 2 | CG | AGPAAGGCGGP | GAACGPAGGG | PPAPGPAA | CGCPCPCAAC | 625 |

P = NapdU

*FIG. 25*

APTAMERS THAT BIND TO IL-6 AND THEIR USE IN TREATING OR DIAGNOSING IL-6 MEDIATED CONDITIONS

FIELD

The present disclosure relates generally to the field of nucleic acids and more particularly to aptamers capable of binding to interleukin-6 (IL-6). In some embodiments, such aptamers are useful as therapeutics for preventing, treating, and/or ameliorating inflammatory diseases, malignant diseases, infections, autoimmune diseases, and other diseases or conditions in which IL-6 has been implicated. In some embodiments, such aptamers are useful for diagnosing IL-6 related diseases or conditions.

BACKGROUND

The following description provides a summary, of information, and is not an admission that any of the information provided or publications referenced herein is prior art to the present disclosure.

Interleukin 6 (IL-6) belongs to cytokine family, characterized by a long chain four-helix bundle structure. Other members of this family include IL-11, IL-17, IL-27, oncostatin-M (OSM), ciliary neurotrophic factor (CNTF), leukemia inhibitory factor (LIF), cardiotrophin-1 (CT-1) and cardiotrophin like cytokine (CLC). IL-6 is produced by B cells, T cells, monocytes, fibroblasts and other cell types and has both pro- or anti-inflammatory properties. It plays pleiotropic roles in a wide range of biological activities including normal cell inflammatory processes, host immune defense mechanisms, and modulation of cellular growth. It is also involved in the proliferation and differentiation of various malignant tumor cells (Guo, Y., et al., Cancer Treatment Reviews, 2012. 38:904-910). Under some acute inflammatory conditions, its concentration can dramatically increase from pg/ml to µg/ml (Waage, A., et al, Clinical Immu and Immunpath, 1989. 50:394-398).

IL-6 activates cells by binding to the non-signaling IL-6 receptor, present on the cell membrane. This ligand-receptor complex then binds to the signal transducing protein, gp130, and activates the janus tyrosin kinase (JAK), resulting in activation of downstream signal transducers and activators of transcription protein 3 (STAT3) signaling pathway (Heinrich, P. C., et al., Biochem J., 1998. 334:297-314). IL-6 also activates the mitogen activated protein kinase (MAPK) pathway (Heinrich, P. C., et al., Biochem J., 2003. 374: 1-20). IL-6R is expressed as a membrane bound protein in only a few cell types, including hepatocytes, neutrophils, monocytes/macrophages and some lymphocytes whereas gp130 is expressed ubiquitously in all cell types and acts as a signaling protein for other members of the IL-6 cytokine family. The IL-6 signal transduction via membrane bound IL-6R is known as the classical signaling pathway in literature. In addition to the membrane bound IL-6R, a soluble form of IL-6R (sIL-6R) is present in high concentration in blood and other body fluids (Honda 1992, Novick 1989), with similar affinity to IL-6. Upon interaction with IL-6, sIL-6R doesn't behave as antagonist, instead it increases the circulating half life of IL-6 and at the same time activates the signaling pathway in cells where IL-6R is not expressed but gp130 is. This signaling pathway activated by IL-6: sIL-6R is known as the trans-signaling mechanism. The ubiquitous expression of gp130 suggests that the IL-6 trans-signaling pathway can activate all or most of the cell types in the body. A soluble form of cellular gp130 acts as an antagonist for IL-6 signaling pathway.

Preclinical studies have shown the role of cytokines in various inflammatory diseases and therefore these have become major therapeutic targets. There are several anti-TNF-α agents in the market that are broadly used to reduce inflammation. Since these are not effective in all patients, there is a need to explore other cytokines for their therapeutic role during inflammation such as IL-6. An anti-IL-6R antibody, tocilizumab, is currently used for treating rheumatoid arthritis.

Aptamers are oligonucleotides that bind their targets with high affinity and specificity. Aptamers may be selected using the SELEX (systematic evolution of ligands by exponential enrichment) method. Slow off rate modified aptamers (SOMAmers) are selected from random libraries containing functional groups absent in natural DNA (Gold et al, 2010, PLoS ONE 5(12): e15004). In some instances, these novel base modifications may mediate hydrophobic interactions between the aptamer and target, leading to significant improvement in binding affinity.

SUMMARY

The present disclosure provides aptamers that bind to interleukin-6 (IL-6) and compositions comprising aptamers that bind to IL-6. The disclosed aptamers are useful as therapeutics for preventing, treating, and/or ameliorating inflammatory diseases, malignant diseases, infections, autoimmune diseases, and/or other diseases or conditions in which IL-6 is implicated. The present disclosure also provides a pharmaceutical compositions or formulations comprising an IL-6 aptamer, or a pharmaceutically acceptable salt thereof, and at least one pharmaceutically acceptable carrier. Such compositions can be prepared in any suitable pharmaceutically acceptable dosage form.

Methods and pharmaceutical compositions or formulations for preventing, treating, and/or ameliorating a disease or condition mediated by IL-6 are provided. In some embodiments, a method comprises administering an IL-6 aptamer, or pharmaceutical compositions or formulations comprising an IL-6 aptamer, to a subject, such as a mammal. In some embodiments, the subject is a human.

In some embodiments, methods and pharmaceutical compositions or formulations are provided for preventing, treating, and/or ameliorating inflammatory diseases, malignant diseases, infections, autoimmune diseases, and/or other diseases or conditions in which IL-6 is implicated. Nonlimiting exemplary inflammatory diseases that may be treated with the IL-6 aptamers described herein include rheumatoid arthritis, juvenile idiopathic arthritis, systemic-onset juvenile idiopathic arthritis, osteoarthritis, sepsis, asthma, interstitial lung disease, inflammatory bowel disease, systemic sclerosis, intraocular inflammation, Graves disease, endometriosis, systemic sclerosis, adult-onset still disease, amyloid A amyloidosis, polymyalgia rheumatic, remitting seronegative symmetrical synovitis with pitting edema, Behcet's disease, uveitis, graft-versus-host diseases, and TNFR-associated periodic syndrome. Malignant diseases that may be treated with the IL-6 aptamers described herein include cancers and cancer-related conditions. Nonlimiting exemplary cancers include multiple myeloma, leukemia, pancreatic cancer, breast cancer, colorectal cancer, cachexia, melanoma, cervical cancer, ovarian cancer, lymphoma, gastrointestinal, lung cancer, prostate cancer, renal cell carcinoma, metastatic kidney cancer, solid tumors, non-small cell lung carcinoma, non-Hodgkin's lymphoma, bladder cancer, oral cancer, myeloproliferative neoplasm, B-cell lymphoproliferative disease, and plasma cell leukemia. Nonlimiting exemplary cancer-related conditions include non-small cell lung cancer-related fatigue and cancer related anorexia. Nonlimiting exemplary infections that may be treated with the IL-6 aptamers described herein include human immunodeficiency virus (HIV), human T-lymphotropic virus (HTLV), cerebral malaria, urinary tract infections, and meningococcal infections. Nonlimiting exemplary autoimmune diseases that may be treated with the IL-6 aptamers described herein include systemic lupus erythromatosus, systemic sclerosis, polymyositis, vasculitis syndrome including giant cell arteritis, takayasu aeteritis, cryoglobulinemia, myeloperoxidase-antineutrophilcytoplasmic antibody-associated crescentic glomerulonephritis, rheumatoid vasculitis, Crohn's disease, relapsing polychondritis, acquired hemophilia A, and autoimmune hemolytic anemia. Further diseases that may be treated with the IL-6 aptamers described herein include, but are not limited to, Castleman's disease, ankylosing spondyliytis, coronary heart disease, cardiovascular disease in rheumatoid arthritis, pulmonary arterial hypertension, chronic obstructive pulmonary disease (COPD), atopic dermatitis, psoriasis, sciatica, type II diabetes, obesity, giant cell arteritis, acute graft-versus-host disease (GVHD), non-ST elevation myocardial infarction, anti-neutrophil cytoplasmic antibody (ANCA) associated vasculitis, neuromyelitis optica, chronic glomerulonephritis, and Takayasu arteritis.

In some embodiments, methods of treating rheumatoid arthritis comprising administering an IL-6 aptamer to a subject are provided. In some embodiments, methods of treating multiple myeloma comprising administering an IL-6 aptamer to a subject are provided.

In some embodiments, aptamers disclosed herein have potential applications ranging from biomarker discovery and diagnostics (Ostroff, R. M., et al., PLoS One, 2010. 5(12): p. e15003; Mehan, M., et al., PLoS One, 2012. in press) to histochemistry and imaging (Gupta, S., et al., Appl Immunohistochem Mol Morphol, 2011. 19(3): p. 273-8).

In some embodiments, a therapeutic effect (e.g., treating, preventing, and/or ameliorating inflammatory diseases, malignant diseases, infections, autoimmune diseases, and other diseases or conditions in which IL-6 has been implicated) may be achieved by administering at least one IL-6 aptamer such that the aptamer is exposed to, and can bind to, IL-6. In some embodiments, such binding occurs regardless of the method of delivery of the aptamer to the subject being treated. In some embodiments, the therapeutic effect may be achieved by administering at least one IL-6 aptamer such that it is exposed to, and binds to, IL-6 and prevents or reduces the binding of IL-6 to one or more cell receptors.

In some embodiments, the binding of an IL-6 aptamer to IL-6 interferes with the binding of IL-6 to an IL-6 receptor. In some embodiments, an IL-6 aptamer reduces signaling along the signal transduction pathway of an IL-6 receptor. In some such embodiments, an IL-6 aptamer inhibits activation of JAK kinases, and/or inhibits phosphorylation of STAT3 and/or SHP2.

In some embodiments, an IL-6 aptamer is administered with one or more additional active agents. Such administration may be sequential or in combination. Nonlimiting exemplary additional active agents include TNF-α inhibitors, IL-1 inhibitors, IL-23 inhibitors, IFN-γ inhibitors, IL-17 inhibitors, IL-22 inhibitors, IL-4/IL-13 inhibitors, IL-13 inhibitors, IL-5 inhibitors, and JAK inhibitors. Nonlimiting exemplary TNF-α inhibitors include infliximab, adalimumab, golimumab, etanercept, certolizumab, ANO128 (Anacor), ART621 (Arena Therapeutics), and anti-TNF-α nanobody (such as ATN-103, Pfizer). Nonlimiting exemplary IL-1 inhibitors include anakinra, canakinumab, XOMA052 (Xoma), and rilonacept. Nonlimiting exemplary IL-23 inhibitors include urtekinumab, briakinumab, apilimod. A nonlimiting exemplary IFN-γ inhibitor is AMG811 (Amgen). Nonlimiting exemplary IL-17 inhibitors include AlN457 (Novartis), ixekizumab, AMG827 (Amgen), and Rg4934 (Roche). A nonlimiting exemplary IL-22 inhibitor is fezakinumab. Nonlimiting exemplary IL-4/IL-13 inhibitors include AMG317 (Amgen), pitrakinra, Nuvance, and AIR645 (Altair). Nonlimiting exemplary IL-13 inhibitors include anrukinzumab, lebrikizumab, CAT-354 (MedImmune), and IMA-026 (Wyeth). A nonlimiting exemplary IL-5 inhibitor is mepolizumab. Nonlimiting exemplary JAK inhibitors include tofacitib and ruxolitinib.

In some embodiments, an in vitro or in vivo diagnostic method comprising contacting an IL-6 aptamer with a sample suspected of comprising IL-6 is provided. In some embodiments, an in vivo diagnostic method comprising administering a suitably labeled IL-6 aptamer to an individual suspected of having a IL-6-mediated disease or disorder is provided, wherein the labeled aptamer is detected for the purpose of diagnosing or evaluating the health status of the individual. The label used may be selected in accordance with the imaging modality to be used. In some embodiments, a diagnostic kit or device comprising an IL-6 aptamer is provided.

In some embodiments, an aptamer that specifically binds IL-6 is provided. In some embodiments, an aptamer specifically binds an IL-6 comprising the amino acid sequence of SEQ ID NO: 10. In some embodiments, an aptamer specifically binds a region of IL-6 defined by amino acids 16 to 31 of SEQ ID NO: 10. In some embodiments, an aptamer specifically binds an epitope of IL-6 comprising amino acids 16 to 31 and amino acids 117 to 125 of SEQ ID NO: 10.

In some embodiments, an aptamer is provided that competes for binding to IL-6 with aptamer of SEQ ID NO: 101. In some embodiments, an aptamer is provided that competes for binding to IL-6 with aptamer of SEQ ID NO: 400.

In any of the embodiments described herein, an aptamer may comprise at least one modified pyrimidine.

In some embodiments, an aptamer comprises a G quartet motif. In some embodiments, the G quartet motif comprises a structure selected from:

(III)
$$\text{5'-GG-ZZZ-GG-Q}_a\text{-GG-Q}_b\text{-GG-3'};$$
(SEQ ID NO: 702)

(IV)
$$\text{5'-GG-Q}_a\text{-GG-ZZZ-GG-Q}_b\text{-GG-3'};$$
(SEQ ID NO: 703)
and (V)
$$\text{5'-GG-Q}_a\text{-GG-Q}_b\text{-GG-ZZZ-GG-3'}.$$
(SEQ ID NO: 704)

In some embodiments, each Z is independently selected from U, T, and a modified pyrimidine. In some embodiments, each Q is independently selected from a linker, a modified nucleotide, and an unmodified nucleotide. In some embodiments, a is 1 to 50, 1 to 40, 1 to 30, 1 to 20, 1 to 15, 1 to 10, or 1 to 5. In some embodiments, b is 1 to 50, 1 to 40, 1 to 30, 1 to 20, 1 to 15, 1 to 10, or 1 to 5. In some embodiments, the aptamer comprises the sequence:

(I)
$$\text{5'-GGCAGGZZZGGZQ}_a\text{GZGG-3'}.$$
(SEQ ID NO: 700)

In some embodiments, each Z is independently selected from U, T, and a modified pyrimidine. In some embodiments, each Q is independently selected from a linker, a modified nucleotide, and an unmodified nucleotide. In some embodiments, a is 1 to 50, 1 to 40, 1 to 30, 1 to 20, 1 to 15, 1 to 10, or 1 to 5.

In some embodiments, an aptamer that specifically binds IL-6 is provided, wherein the aptamer comprises a sequence selected from:

(VI)
(SEQ ID NO: 705)
5'-YXAXGYARQ$_a$MGYAAGSCGRY-3';
and (VII)
(SEQ ID NO: 706)
5'-MGYAAGSCGRYQ$_b$YXAXGYAR-3'.

In some embodiments, each Y is independently selected from a modified pyrimidine. In some embodiments, each X is independently selected from a modified pyrimidine. In some embodiments, M is selected from C and A and S is selected from C and G, and each R is independently selected from G and A. In some embodiments, each Q is independently selected from a linker, a modified nucleotide, and an unmodified nucleotide. In some embodiments, a is 1 to 30, 1 to 20, 1 to 15, 1 to 10, or 1 to 5. In some embodiments, b is 1 to 30, 1 to 20, 1 to 15, 1 to 10, or 1 to 5.

In some embodiments, e.g., of SEQ ID NOs: 700 and 702 to 706, each Q is independently selected from a substituted or unsubstituted $C_2$-$C_{20}$ linker, an alkylene glycol, and a polyalkylene glycol. In some embodiments, each Q is independently selected from a substituted or unsubstituted $C_2$-$C_{20}$ linker, a 1,3-propane diol, a poly(1,3-propane diol) having from 2 to 100 1,3-propane diol units, an ethylene glycol, and a polyethylene glycol having from 2 to 100 ethylene glycol units. In some embodiments, each substituted or unsubstituted $C_2$-$C_{20}$ linker is a substituted or unsubstituted $C_2$-$C_8$ linker, a substituted or unsubstituted $C_2$-$C_6$ linker, a substituted or unsubstituted $C_2$-$C_5$ linker, a substituted or unsubstituted $C_2$-$C_4$ linker, or a substituted or unsubstituted $C_3$ linker.

In some embodiments, an aptamer that specifically binds IL-6 is provided, wherein the aptamer comprises the sequence:

(II)
(SEQ ID NO: 701)
5'-GGGYXAXGYAGCL$_b$GZGCGYAAGGCGGY-3'.

In some embodiments, Z is selected from U, T, and a modified pyrimidine. In some embodiments, each Y is independently selected from a modified pyrimidine. In some embodiments, each X is independently selected from a modified pyrimidine. In some embodiments, each L is independently selected from a linker, a modified nucleotide, and an unmodified nucleotide. In some embodiments, b is 1 to 20, 1 to 15, 1 to 10, or 1 to 5.

In some embodiments, e.g., of SEQ ID NO: 701, each L is independently selected from a substituted or unsubstituted $C_2$-$C_{20}$ linker, an alkylene glycol, and a polyalkylene glycol. In some embodiments, each L is independently selected from a substituted or unsubstituted $C_2$-$C_{20}$ linker, a 1,3-propane diol, a poly(1,3-propane diol) having from 2 to 100 1,3-propane diol units, an ethylene glycol, and a polyethylene glycol having from 2 to 100 ethylene glycol units. In some embodiments, each substituted or unsubstituted $C_2$-$C_{20}$ linker is a substituted or unsubstituted $C_2$-$C_8$ linker, a substituted or unsubstituted $C_2$-$C_6$ linker, a substituted or unsubstituted $C_2$-$C_5$ linker, a substituted or unsubstituted $C_2$-$C_4$ linker, or a substituted or unsubstituted $C_3$ linker.

In any of the embodiments described herein, each X may be independently selected from an aromatic modified pyrimidine. In any of the embodiments described herein, each X may be independently selected from the aromatic modified pyrimidines shown in FIG. 20 and FIG. 24. In any of the embodiments described herein, each X may be independently selected from Nap, 2Nap, NE, BF, and BT in FIG. 24.

In any of the embodiments described herein, each Y may be independently selected from the modified pyrimidines shown in FIG. 20 and FIG. 24. In any of the embodiments described herein, each Y may be independently selected from the modified pyrimidines shown in FIG. 24.

In any of the embodiments described herein, each Z may be independently selected from U, T, and the modified pyrimidines shown in FIG. 20 and FIG. 24. In any of the embodiments described herein, each Z may be independently selected from U, T, and the modified pyrimidines shown in FIG. 24.

In any of the embodiments described herein, each modified pyrimidine may be independently selected from:
5-(N-benzylcarboxyamide)-2'-deoxyuridine (BndU),
5-(N-benzylcarboxyamide)-2'-O-methyluridine,
5-(N-benzylcarboxyamide)-2'-fluorouridine,
5-(N-phenethylcarboxyamide)-2'-deoxyuridine (PEdU),
5-(N-thiophenylmethylcarboxyamide)-2'-deoxyuridine (ThdU),
5-(N-isobutylcarboxyamide)-2'-deoxyuridine (iBudU),
5-(N-tyrosylcarboxyamide)-2'-deoxyuridine (TyrdU),
5-(N-3,4-methylenedioxybenzylcarboxyamide)-2'-deoxyuridine (MBndU),
5-(N-4-fluorobenzylcarboxyamide)-2'-deoxyuridine (FBndU),
5-(N-3-phenylpropylcarboxyamide)-2'-deoxyuridine (PPdU),
5-(N-imidizolylethylcarboxyamide)-2'-deoxyuridine (ImdU),
5-(N-isobutylcarboxyamide)-2'-O-methyluridine,
5-(N-isobutylcarboxyamide)-2'-fluorouridine,
5-(N-tryptaminocarboxyamide)-2'-deoxyuridine (TrpdU),
5-(N—R-threoninylcarboxyamide)-2'-deoxyuridine (ThrdU),
5-(N-tryptaminocarboxyamide)-2'-O-methyluridine,
5-(N-tryptaminocarboxyamide)-2'-fluorouridine,
5-(N-[1-(3-trimethylamonium)propyl]carboxyamide)-2'-deoxyuridine chloride,
5-(N-naphthylmethylcarboxyamide)-2'-deoxyuridine (NapdU),
5-(N-naphthylmethylcarboxyamide)-2'-O-methyluridine,
5-(N-naphthylmethylcarboxyamide)-2'-fluorouridine,
5-(N-[1-(2,3-dihydroxypropyl)]carboxyamide)-2'-deoxyuridine),
5-(N-2-naphthylmethylcarboxyamide)-2'-deoxyuridine (2NapdU),
5-(N-2-naphthylmethylcarboxyamide)-2'-O-methyluridine,
5-(N-2-naphthylmethylcarboxyamide)-2'-fluorouridine,
5-(N-1-naphthylethylcarboxyamide)-2'-deoxyuridine (NEdU),
5-(N-1-naphthylethylcarboxyamide)-2'-O-methyluridine,
5-(N-1-naphthylethylcarboxyamide)-2'-fluorouridine,
5-(N-2-naphthylethylcarboxyamide)-2'-deoxyuridine (2NEdU),
5-(N-2-naphthylethylcarboxyamide)-2'-O-methyluridine,
5-(N-2-naphthylethylcarboxyamide)-2'-fluorouridine, 5-(N-3-benzofuranylethylcarboxyamide)-2'-deoxyuridine (BFdU),
5-(N-3-benzofuranylethylcarboxyamide)-2'-O-methyluridine,
5-(N-3-benzofuranylethylcarboxyamide)-2'-fluorouridine,
5-(N-3-benzothiophenylethylcarboxyamide)-2'-deoxyuridine (BTdU),
5-(N-3-benzothiophenylethylcarboxyamide)-2'-O-methyluridine, and
5-(N-3-benzothiophenylethylcarboxyamide)-2'-fluorouridine.

In any of the embodiments described herein, each X may be independently selected from:
5-(N-1-naphthylmethylcarboxyamide)-2'-deoxyuridine (NapdU),
5-(N-1-naphthylmethylcarboxyamide)-2'-O-methyluridine,
5-(N-1-naphthylmethylcarboxyamide)-2'-fluorouridine,
5-(N-2-naphthylmethylcarboxyamide)-2'-deoxyuridine (2NapdU),
5-(N-2-naphthylmethylcarboxyamide)-2'-O-methyluridine,
5-(N-2-naphthylmethylcarboxyamide)-2'-fluorouridine,
5-(N-1-naphthylethylcarboxyamide)-2'-deoxyuridine (NEdU),
5-(N-1-naphthylethylcarboxyamide)-2'-O-methyluridine,
5-(N-1-naphthylethylcarboxyamide)-2'-fluorouridine,
5-(N-2-naphthylethylcarboxyamide)-2'-deoxyuridine (2NEdU),
5-(N-2-naphthylethylcarboxyamide)-2'-O-methyluridine,
5-(N-2-naphthylethylcarboxyamide)-2'-fluorouridine,
5-(N-3-benzofuranylethylcarboxyamide)-2'-deoxyuridine (BFdU),
5-(N-3-benzofuranylethylcarboxyamide)-2'-O-methyluridine,
5-(N-3-benzofuranylethylcarboxyamide)-2'-fluorouridine,
5-(N-3-benzothiophenylethylcarboxyamide)-2'-deoxyuridine (BTdU),
5-(N-3-benzothiophenylethylcarboxyamide)-2'-O-methyluridine, and
5-(N-3-benzothiophenylethylcarboxyamide)-2'-fluorouridine.

In some embodiments, an aptamer is provided that comprises a sequence selected from: (a) a nucleotide sequence selected from SEQ ID NOs: 7, 8, 11, 19 to 22, 26 to 39, 100 to 239, 300 to 356, 400 to 446, 500 to 572, and 599 to 625; or (b) a nucleotide sequence selected from SEQ ID NOs: 7, 8, 11, 19 to 22, 26 to 39, 100 to 239, 300 to 356, 400 to 446, 500 to 572, and 599 to 625, wherein 1 to 20 nucleotide are substituted, deleted, or inserted; wherein the aptamer specifically binds IL-6 with an affinity ($K_d$) of less than 20 nM; or (c) a nucleotide sequence having that is at least 80% or more, identical to a nucleotide sequence selected from SEQ ID NOs: 7, 8, 11, 19 to 22, 26 to 39, 100 to 239, 300 to 356, 400 to 446, 500 to 572, and 599 to 625; wherein the aptamer specifically binds IL-6 with an affinity ($K_d$) of less than 10 nM. In some embodiments, the aptamer has IL-6 antagonist activity ($IC_{50}$) of less than 10 nM.

In any of the embodiments described herein, the aptamer may comprise at least 2 to 6 modified pyrimidines and/or a 2'-OMe. In any of the embodiments described herein, an aptamer may comprise at least one, or at least 2 to 5 phosphorothioate linkages.

In some embodiments, the aptamer binds IL-6 with an affinity (Kd) of less than 20 nM. In some embodiments, the aptamer inhibits at least one of activity selected from IL-6 binding to an IL-6 receptor, STAT3 phosphorylation, and STAT-mediated transcription.

In some embodiments, a pharmaceutical composition is provided that comprises any of the aptamers described herein, or pharmaceutically acceptable salt thereof, and a pharmaceutically acceptable carrier. In some embodiments, the pharmaceutical composition is for treating a disease or condition mediated by IL-6.

In some embodiments, methods of treating a disease or condition mediated by IL-6 are provided. In some embodiments, a method comprises administering an aptamer described herein. In some embodiments, a method comprises administering a pharmaceutical composition that comprises any of the aptamers described herein, or pharmaceutically acceptable salt thereof, and a pharmaceutically acceptable carrier.

In some embodiments, the disease or condition mediated by IL-6 is selected from an inflammatory disease, a malignant disease, an infection, and an autoimmune disease.

In some embodiments, the disease or condition mediated by IL-6 is selected from Castleman's disease, ankylosing spondyliytis, coronary heart disease, cardiovascular disease in rheumatoid arthritis, pulmonary arterial hypertension, chronic obstructive pulmonary disease (COPD), atopic dermatitis, psoriasis, sciatica, type II diabetes, obesity, giant cell arteritis, acute graft-versus-host disease (GVHD), non-ST elevation myocardial infarction, anti-neutrophil cytoplasmic antibody (ANCA) associated vasculitis, neuromyelitis optica, chronic glomerulonephritis, and Takayasu arteritis.

In some embodiments, the disease or condition mediated by IL-6 is an inflammatory disease selected from rheumatoid arthritis, juvenile idiopathic arthritis, systemic-onset juvenile idiopathic arthritis, osteoarthritis, sepsis, asthma, interstitial lung disease, inflammatory bowel disease, systemic sclerosis, intraocular inflammation, Graves disease, endometriosis, systemic sclerosis, adult-onset still disease, amyloid A amyloidosis, polymyalgia rheumatic, remitting seronegative symmetrical synovitis with pitting edema, Behcet's disease, uveitis, graft-versus-host diseases, and TNFR-associated periodic syndrome.

In some embodiments, the disease or condition mediated by IL-6 is a malignant disease selected from cancer and a cancer-related condition. In some embodiments, the malignant disease is a cancer selected from multiple myeloma, leukemia, pancreatic cancer, breast cancer, colorectal cancer, cachexia, melanoma, cervical cancer, ovarian cancer, lymphoma, gastrointestinal, lung cancer, prostate cancer, renal cell carcinoma, metastatic kidney cancer, solid tumors, glioma, liver cancer, non-small cell lung carcinoma, non-Hodgkin's lymphoma, bladder cancer, oral cancer, myeloproliferative neoplasm, B-cell lymphoproliferative disease, and plasma cell leukemia. In some embodiments, the malignant disease is a cancer-related condition selected from non-small cell lung cancer-related fatigue and cancer related anorexia.

In some embodiments, the disease or condition mediated by IL-6 is an infection selected from human immunodeficiency virus (HIV), human T-lymphotropic virus (HTLV), cerebral malaria, a urinary tract infection, and a meningococcal infection.

In some embodiments, the disease or condition mediated by IL-6 is an autoimmune disease selected from systemic lupus erythromatosus, systemic sclerosis, polymyositis, vasculitis syndrome including giant cell arteritis, takayasu aeteritis, cryoglobulinemia, myeloperoxidase-antineutrophilcytoplasmic antibody-associated crescentic glomerulonephritis, rheumatoid vasculitis, Crohn's disease, relapsing polychondritis, acquired hemophilia A, and autoimmune hemolytic anemia.

In some embodiments, the present disclosure provides two co-crystal structures of aptamers bound to IL-6, solved at a resolution of 2.4 Å and 2.55 Å.

In some embodiments, the present disclosure provides aptamers that specifically bind to IL-6, wherein said aptamer binds to IL-6 with less than or equal to 1 polar contact per 100 $Å^2$ of interface area, wherein said polar contact is comprised of one or more hydrogen bonds and one or more charge-charge interactions, and interface area is fraction of protein surface occupied by the aptamer. As a nonlimiting example, aptamer 2573-20_136 (SEQ ID NO: 101) binds IL-6 with a ratio of polar contacts to interface area of 0.0072. Thus, in some embodiments, the present disclosure provides aptamers that bind IL-6 with a ratio of polar contacts to interface area of less than 0.01, less than 0.009, less than 0.008, or about 0.007.

BRIEF DESCRIPTION OF THE DRAWINGS

FIGS. 8A and B show stability of certain modified dU-containing aptamers and dT control aptamers in 90% human serum, as described in Example 7. FIG. 8C shows stability of certain modified dU-containing aptamers and dT control aptamers in human, rat, and cynomolgus monkey serum, as described in Example 7.

FIG. 14 shows the G-quartet motif (domain 1), as described in Example 13. (A) The G-tetrads each contain two G-bases in the syn (magenta) and anti conformations (white). The bases hydrogen bond to neighboring G-bases through the Watson-Crick face as well as the Hoogsteen face. Each tetrad coordinates one $Na^+$ ion. (B) The G-quadruplex conformation in the SOMAmer structure is up-up-down-down with three lateral loops. (C) Hydrophobic pocket created by modified bases Bn-dU7, Bn-dU8, Nap-dU12 and Bn-dU30. Pi-stacking interactions occur between the uridine ring of Bn-dU7 and Nap-dU12 with Bn8. There is edge-to-face interaction between the stacked bases and Bn7 and Bn30. (D) PE-dU9 base stacks on G32 and the modified group is exposed to solvent.

FIG. 21 shows an exemplary sequence for human IL-6 precursor (SEQ ID NO: 9). The signal sequence (amino acids 1 to 28) is underlined. An exemplary mature human IL-6 comprises amino acids 29 to 212 of SEQ ID NO: 9, and is shown in SEQ ID NO: 10.

FIG. 22 shows a summary of systematic replacement of modified nucleotides in the G-quartet fragment (2573-20_324 (SEQ ID NO: 319)), as described in Example 13. Values shown are the ratio of the $K_d$ values ($K_d^{variant}/K_d^{parent}$). The $K_d$ value for the parent fragment (2573-20_324 (SEQ ID NO: 319)) is $2.7 \times 10^{-7}$ M.

FIG. 23 shows an alignment of unique SOMAmer sequences with G quartet motifs from the final SELEX pool, as described in Example 14.

FIG. 24 shows certain exemplary 5-dU modifications, as discussed in Example 15. Each modification structure is attached to dU as shown, e.g., in FIG. 3.

FIG. 25 shows an alignment of unique SOMAmer sequences with similar sequence motifs as SOMAmer 2574-49 (SEQ ID NO: 8) as described in Example 14.

DETAILED DESCRIPTION

Figure 1:
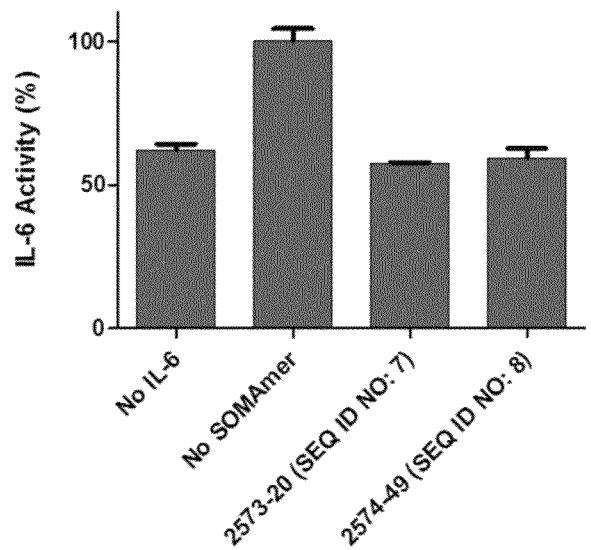
FIG. 1 shows inhibition of TF-1 cell proliferation by aptamers that bind IL-6, as described in Example 2.

Reference will now be made in detail to representative embodiments of the invention. While the invention will be described in conjunction with the enumerated embodiments, it will be understood that the invention is not intended to be limited to those embodiments. On the contrary, the invention is intended to cover all alternatives, modifications, and equivalents that may be included within the scope of the present invention as defined by the claims.

One skilled in the art will recognize many methods and materials similar or equivalent to those described herein, which could be used in and are within the scope of the practice of the present invention. The present invention is in no way limited to the methods and materials described.

Unless defined otherwise, technical and scientific terms used herein have the same meaning as commonly understood by one of ordinary skill in the art(s) to which this invention belongs. Although any methods, devices, and materials similar or equivalent to those described herein can be used in the practice or testing of the invention, the preferred methods, devices and materials are now described.

All publications, published patent documents, and patent applications cited in this disclosure are indicative of the level of skill in the art(s) to which the disclosure pertains. All publications, published patent documents, and patent applications cited herein are hereby incorporated by reference to the same extent as though each individual publication, published patent document, or patent application was specifically and individually indicated as being incorporated by reference.

As used in this disclosure, including the appended claims, the singular forms "a," "an," and "the" include plural references, unless the content clearly dictates otherwise, and are used interchangeably with "at least one" and "one or more." Thus, reference to "an aptamer" includes mixtures of aptamers, and the like.

As used herein, the term "about" represents an insignificant modification or variation of the numerical value such that the basic function of the item to which the numerical value relates is unchanged.

As used herein, the terms "comprises," "comprising," "includes," "including," "contains," "containing," and any variations thereof, are intended to cover a non-exclusive inclusion, such that a process, method, product-by-process, or composition of matter that comprises, includes, or contains an element or list of elements does not include only those elements but may include other elements not expressly listed or inherent to such process, method, product-by-process, or composition of matter.

As used herein, the term "nucleotide" refers to a ribonucleotide or a deoxyribonucleotide, or a modified form thereof, as well as an analog thereof. Nucleotides include species that include purines (e.g., adenine, hypoxanthine, guanine, and their derivatives and analogs) as well as pyrimidines (e.g., cytosine, uracil, thymine, and their derivatives and analogs). When a base is indicated as "A", "C", "G", "U", or "T", it is intended to encompass both ribonucleotides and deoxyribonucleoties, and modified forms and analogs thereof.

As used herein, "nucleic acid," "oligonucleotide," and "polynucleotide" are used interchangeably to refer to a polymer of nucleotides and include DNA, RNA, DNA/RNA hybrids and modifications of these kinds of nucleic acids, oligonucleotides and polynucleotides, wherein the attachment of various entities or moieties to the nucleotide units at any position are included. The terms "polynucleotide," "oligonucleotide," and "nucleic acid" include double- or single-stranded molecules as well as triple-helical molecules. Nucleic acid, oligonucleotide, and polynucleotide are broader terms than the term aptamer and, thus, the terms nucleic acid, oligonucleotide, and polynucleotide include polymers of nucleotides that are aptamers but the terms nucleic acid, oligonucleotide, and polynucleotide are not limited to aptamers.

As used herein, the terms "modify", "modified", "modification", and any variations thereof, when used in reference to an oligonucleotide, means that at least one of the four constituent nucleotide bases (i.e., A, G, T/U, and C) of the oligonucleotide is an analog or ester of a naturally occurring nucleotide. In some embodiments, the modified nucleotide confers nuclease resistance to the oligonucleotide. In some embodiments, the modified nucleotides lead to predominantly hydrophobic interactions of aptamers with protein targets resulting in high binding efficiency and stable co-crystal complexes. A pyrimidine with a substitution at the C-5 position is an example of a modified nucleotide. Modifications can include backbone modifications, methylations, unusual base-pairing combinations such as the isobases isocytidine and isoguanidine, and the like. Modifications can also include 3' and 5' modifications, such as capping. Other modifications can include substitution of one or more of the naturally occurring nucleotides with an analog, internucleotide modifications such as, for example, those with uncharged linkages (e.g., methyl phosphonates, phosphotriesters, phosphoamidates, carbamates, etc.) and those with charged linkages (e.g., phosphorothioates, phosphorodithioates, etc.), those with intercalators (e.g., acridine, psoralen, etc.), those containing chelators (e.g., metals, radioactive metals, boron, oxidative metals, etc.), those containing alkylators, and those with modified linkages (e.g., alpha anomeric nucleic acids, etc.). Further, any of the hydroxyl groups ordinarily present on the sugar of a nucleotide may be replaced by a phosphonate group or a phosphate group; protected by standard protecting groups; or activated to prepare additional linkages to additional nucleotides or to a solid support. The 5' and 3' terminal OH groups can be phosphorylated or substituted with amines, organic capping group moieties of from about 1 to about 20 carbon atoms, polyethylene glycol (PEG) polymers, in some embodiments, ranging from about 10 to about 80 kDa, PEG polymers, in some embodiments, ranging from about 20 to about 60 kDa, or other hydrophilic or hydrophobic biological or synthetic polymers. In one embodiment, modifications are of the C-5 position of pyrimidines. These modifications can be produced through an amide linkage directly at the C-5 position or by other types of linkages.

Polynucleotides can also contain analogous forms of ribose or deoxyribose sugars that are generally known in the art, including 2'-O-methyl-, 2'-O-allyl, 2'-fluoro- or 2'-azido-ribose, carbocyclic sugar analogs, α-anomeric sugars, epimeric sugars such as arabinose, xyloses or lyxoses, pyranose sugars, furanose sugars, sedoheptuloses, acyclic analogs and abasic nucleoside analogs such as methyl riboside. As noted above, one or more phosphodiester linkages may be replaced by alternative linking groups. These alternative linking groups include embodiments wherein phosphate is replaced by P(O)S ("thioate"), P(S)S ("dithioate"), (O)NR$_2$ ("amidate"), P(O)R, P(O)OR', CO or CH$_2$ ("formacetal"), in which each R or R' is independently H or substituted or unsubstituted alkyl (1-20 C) optionally containing an ether (—O—) linkage, aryl, alkenyl, cycloalkyl, cycloalkenyl or araldyl. Not all linkages in a polynucleotide need be identical. Substitution of analogous forms of sugars, purines, and pyrimidines can be advantageous in designing a final product, as can alternative backbone structures like a polyamide backbone, for example.

As used herein, the term "nuclease" refers to an enzyme capable of cleaving the phosphodiester bond between nucleotide subunits of an oligonucleotide. As used herein, the term "endonuclease" refers to an enzyme that cleaves phosphodiester bond(s) at a site internal to the oligonucleotide. As used herein, the term "exonuclease" refers to an enzyme which cleaves phosphodiester bond(s) linking the end nucleotides of an oligonucleotide. Biological fluids typically contain a mixture of both endonucleases and exonucleases.

As used herein, the terms "nuclease resistant" and "nuclease resistance" refers to the reduced ability of an oligonucleotide to serve as a substrate for an endo- or exonuclease, such that, when contacted with such an enzyme, the oligonucleotide is either not degraded or is degraded more slowly than an oligonucleotide composed of unmodified nucleotides.

Figure 20:
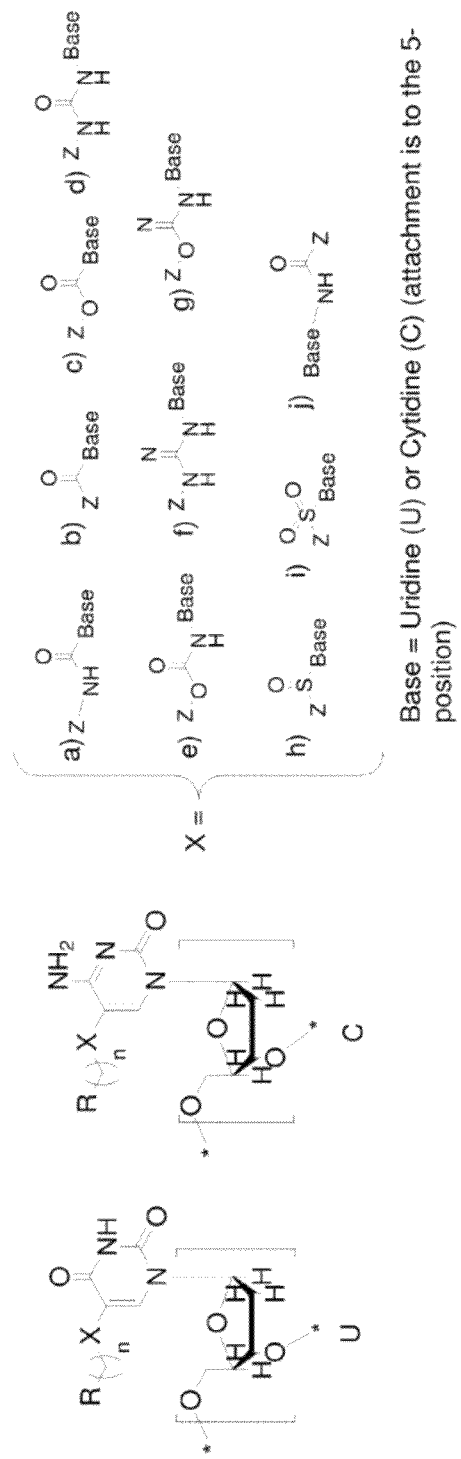
FIG. 20 shows certain exemplary modified pyrimidines that may be incorporated into aptamers, such as slow off-rate aptamers.
Figure 20:
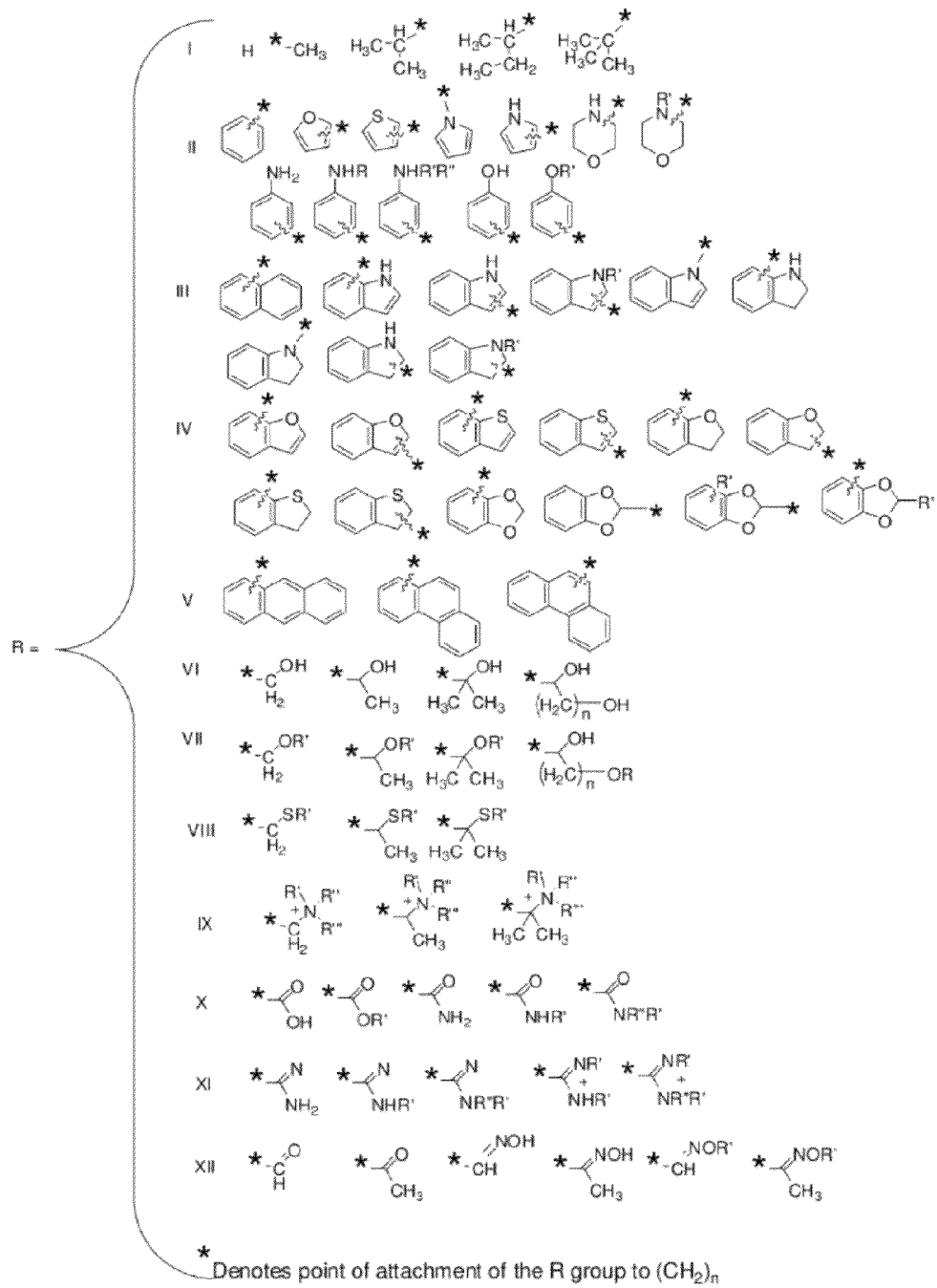

As used herein, the term "C-5 modified pyrimidine" refers to a pyrimidine with a modification at the C-5 position including, but not limited to, those moieties illustrated in FIG. 20 and FIG. 24. Examples of a C-5 modified pyrimidine include those described in U.S. Pat. Nos. 5,719,273 and 5,945,527. Examples of a C-5 modification include substitution of deoxyuridine at the C-5 position with a substituent independently selected from: benzylcarboxyamide (alternatively benzylaminocarbonyl) (Bn), naphthylmethylcarboxyamide (alternatively naphthylmethylaminocarbonyl) (Nap), tryptaminocarboxyamide (alternatively tryptaminocarbonyl) (Trp), phenethylcarboxyamide (alternatively phenethylamino carbonyl) (Pe), thiophenylmethylcarboxyamide (alternatively thiophenylmethylaminocarbonyl) (Th) and isobutylcarboxyamide (alternatively isobutylaminocarbonyl) (iBu) as illustrated immediately below.

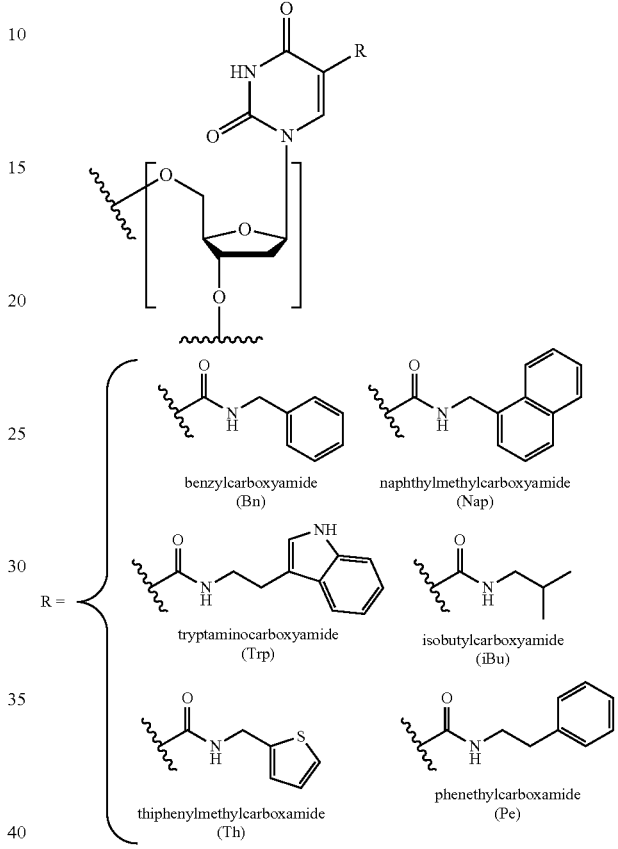

Chemical modifications of a C-5 modified pyrimidine can also be combined with, singly or in any combination, 2'-position sugar modifications, modifications at exocyclic amines, and substitution of 4-thiouridine and the like.

Representative C-5 modified pyrimidines include: 5-(N-benzylcarboxyamide)-2'-deoxyuridine (BndU), 5-(N-benzylcarboxyamide)-2'-O-methyluridine, 5-(N-benzylcarboxyamide)-2'-fluorouridine, 5-(N-isobutylcarboxyamide)-2'-deoxyuridine (iBudU), 5-(N-isobutylcarboxyamide)-2'-O-methyluridine, 5-(N-phenethylcarboxyamide)-2'-deoxyuridine (PedU), 5-(N-thiophenylmethylcarboxyamide)-2'-deoxyuridine (ThdU), 5-(N-isobutylcarboxyamide)-2'-fluorouridine, 5-(N-tryptaminocarboxyamide)-2'-deoxyuridine (TrpdU), 5-(N-tryptaminocarboxyamide)-2'-O-methyluridine, 5-(N-tryptaminocarboxyamide)-2'-fluorouridine, 5-(N-[1-(3-trimethylamonium)propyl]carboxyamide)-2'-deoxyuridine chloride, 5-(N-naphthylmethylcarboxyamide)-2'-deoxyuridine (NapdU), 5-(N-naphthylmethylcarboxyamide)-2'-O-methyluridine, 5-(N-naphthylmethylcarboxyamide)-2'-fluorouridine or 5-(N-[1-(2,3-dihydroxypropyl)]carboxyamide)-2'-deoxyuridine).

Nucleotides can be modified either before or after synthesis of an oligonucleotide. A sequence of nucleotides in an oligonucleotide may be interrupted by one or more nonnucleotide components. A modified oligonucleotide may be further modified after polymerization, such as, for example, by conjugation with any suitable labeling component.

As used herein, the term "at least one pyrimidine," when referring to modifications of a nucleic acid, refers to one, several, or all pyrimidines in the nucleic acid, indicating that any or all occurrences of any or all of C, T, or U in a nucleic acid may be modified or not.

As used herein, "nucleic acid ligand," "aptamer," and "clone" are used interchangeably to refer to a non-naturally occurring nucleic acid that has a desirable action on a target molecule. A desirable action includes, but is not limited to, binding of the target, catalytically changing the target, reacting with the target in a way that modifies or alters the target or the functional activity of the target, covalently attaching to the target (as in a suicide inhibitor), and facilitating the reaction between the target and another molecule. In one embodiment, the action is specific binding affinity for a target molecule, such target molecule being a three dimensional chemical structure other than a polynucleotide that binds to the nucleic acid ligand through a mechanism which is independent of Watson/Crick base pairing or triple helix formation, wherein the aptamer is not a nucleic acid having the known physiological function of being bound by the target molecule. Aptamers to a given target include nucleic acids that are identified from a candidate mixture of nucleic acids, where the aptamer is a ligand of the target, by a method comprising: (a) contacting the candidate mixture with the target, wherein nucleic acids having an increased affinity to the target relative to other nucleic acids in the candidate mixture can be partitioned from the remainder of the candidate mixture; (b) partitioning the increased affinity nucleic acids from the remainder of the candidate mixture; and (c) amplifying the increased affinity nucleic acids to yield a ligand-enriched mixture of nucleic acids, whereby aptamers of the target molecule are identified. It is recognized that affinity interactions are a matter of degree; however, in this context, the "specific binding affinity" of an aptamer for its target means that the aptamer binds to its target generally with a much higher degree of affinity than it binds to other, non-target, components in a mixture or sample. An "aptamer" or "nucleic acid ligand" is a set of copies of one type or species of nucleic acid molecule that has a particular nucleotide sequence. An aptamer can include any suitable number of nucleotides. "Aptamers" refer to more than one such set of molecules. Different aptamers can have either the same or different numbers of nucleotides. Aptamers may be DNA or RNA and may be single stranded, double stranded, or contain double stranded or triple stranded regions.

As used herein, a "SOMAmer" or Slow Off-Rate Modified Aptamer refers to an aptamer (including an aptamers comprising at least one nucleotide with a hydrophobic modification) with an off-rate ($t_{1/2}$) of ≥30 minutes, ≥60 minutes, ≥90 minutes, ≥120 minutes, ≥150 minutes, ≥180 minutes, ≥210 minutes, or ≥240 minutes. In some embodiments, SOMAmers are generated using the improved SELEX methods described in U.S. Pat. No. 7,947,447, entitled "Method for Generating Aptamers with Improved Off-Rates".

As used here, a "G quartet" is a nucleotide sequence motif that comprises four pairs of G nucleotides with at least one nucleotide or spacer group between each pair of G nucleotides. G quartet motifs are described, e.g., in Lane, A. N., et al., NAR, 2008. 36(17): 5482:5515.

As used herein, "protein" is used synonymously with "peptide," "polypeptide," or "peptide fragment." A "purified" polypeptide, protein, peptide, or peptide fragment is substantially free of cellular material or other contaminating proteins from the cell, tissue, or cell-free source from which the amino acid sequence is obtained, or substantially free from chemical precursors or other chemicals when chemically synthesized.

As used herein, "inflammatory disease" refers to a disease or condition involving an inflammatory response. The inflammatory response may be acute and/or chronic. In some embodiments, chronic inflammation involves an increase in the level of IL-6. Nonlimiting exemplary inflammatory diseases that may be treated with the IL-6 aptamers described herein include rheumatoid arthritis, juvenile idiopathic arthritis, systemic-onset juvenile idiopathic arthritis, osteoarthritis, sepsis, asthma, interstitial lung disease, inflammatory bowel disease, systemic sclerosis, intraocular inflammation, Graves disease, endometriosis, systemic sclerosis, adult-onset still disease, amyloid A amyloidosis, polymyalgia rheumatic, remitting seronegative symmetrical synovitis with pitting edema, Behcet's disease, uveitis, graft-versus-host diseases, and TNFR-associated periodic syndrome.

As used herein, "malignant disease" includes cancer and cancer-related conditions.

As used herein, "cancer" means a disease or condition involving unregulated and abnormal cell growth. Nonlimiting exemplary cancers that may be treated with the IL-6 aptamers described herein include multiple myeloma, leukemia, pancreatic cancer, breast cancer, colorectal cancer, cachexia, melanoma, cervical cancer, ovarian cancer, lymphoma, gastrointestinal, lung cancer, prostate cancer, renal cell carcinoma, metastatic kidney cancer, solid tumors, non-small cell lung carcinoma, non-Hodgkin's lymphoma, bladder cancer, oral cancer, myeloproliferative neoplasm, B-cell lymphoproliferative disease, and plasma cell leukemia. Nonlimiting exemplary cancer-related conditions include non-small cell lung cancer-related fatigue and cancer related anorexia.

As used herein, "infection" refers to a disease or condition caused by a pathogen, such as a bacteria, virus, fungus, etc. Nonlimiting exemplary infections that may be treated with the IL-6 aptamers described herein include human immunodeficiency virus (HIV), human T-lymphotropic virus (HTLV), cerebral malaria, urinary tract infections, and meningococcal infections.

As used herein, "autoimmune disease" refers to a disease or condition arising from an inappropriate immune response against the body's own components, such as tissues and other components. In some embodiments, IL-6 levels are elevated in autoimmune disease. Nonlimiting exemplary autoimmune diseases that may be treated with the IL-6 aptamers described herein include systemic lupus erythromatosus, systemic sclerosis, polymyositis, vasculitis syndrome including giant cell arteritis, takayasu aeteritis, cryoglobulinemia, myeloperoxidase-antineutrophilcytoplasmic antibody-associated crescentic glomerulonephritis, rheumatoid vasculitis, Crohn's disease, relapsing polychondritis, acquired hemophilia A, and autoimmune hemolytic anemia.

As used herein, an "IL-6 mediated disease or condition" refers to a disease or condition in which at least some of the symptoms and/or progression of the disease or condition is caused by IL-6-mediated signaling. Nonlimiting exemplary IL-6 mediated diseases or conditions include inflammatory diseases, malignant diseases (including cancer and cancer-related conditions), infections, and autoimmune diseases. Further nonlimiting exemplary IL-6 mediated diseases include, but are not limited to, Castleman's disease, ankylosing spondyliytis, coronary heart disease, cardiovascular disease in rheumatoid arthritis, pulmonary arterial hypertension, chronic obstructive pulmonary disease (COPD), atopic dermatitis, psoriasis, sciatica, type II diabetes, obesity, giant cell arteritis, acute graft-versus-host disease (GVHD), non-ST elevation myocardial infarction, anti-neutrophil cytoplasmic antibody (ANCA) associated vasculitis, neuromyelitis optica, chronic glomerulonephritis, and Takayasu arteritis.

As used herein, "modulate" means to alter, either by increasing or decreasing, the level of a peptide or polypeptide, or to alter, either by increasing or decreasing, the stability or activity of a peptide or a polypeptide. The term "inhibit" means to decrease the level of a peptide or a polypeptide or to decrease the stability or activity of a peptide or a polypeptide. As described herein, the protein which is modulated or inhibited is IL-6.

As used herein, the term "bioactivity" indicates an effect on one or more cellular or extracellular process (e.g., via binding, signaling, etc.) which can impact physiological or pathophysiological processes.

As used herein, the terms "interleukin-6" and "IL-6" refer to naturally-occurring IL-6, including naturally-occurring isoforms and variants. As used herein, IL-6 includes all mammalian species of IL-6, including human, canine, feline, murine, primate, equine, and bovine. A nonlimiting exemplary human IL-6 precursor has the sequence shown in Swiss-Prot Accession No. P05231.1, shown in FIG. 21 (SEQ ID NO: 9). A nonlimiting exemplary mature human IL-6 comprises amino acids 29 to 212 of Swiss-Prot Accession No. P05231.1 (SEQ ID NO: 10).

As used herein, "IL-6 receptor" refers to a receptor that is bound by and activated by IL-6, such as the IL-6 receptor, which comprises two subunits: IL-6R (also referred to as IL-6 receptor subunit a) and gp130 (also referred to as IL-6 receptor subunit 13). IL-6 receptors include the receptors of any mammalian species, including, but are not limited to, human, canine, feline, murine, equine, primate, and bovine. A nonlimiting exemplary human IL-6R precursor has the sequence shown in Swiss-Prot Accession No. P08887.1. A nonlimiting exemplary human IL-6R mature protein has the sequence of amino acids 20 to 468 of Swiss-Prot Accession No. P08887.1. A nonlimiting exemplary human gp130 precursor has the sequence shown in Swiss-Prot Accession No. P40189.2. A nonlimiting exemplary human gp130 mature protein has the sequence of amino acids 23 to 918 of Swiss-Prot Accession No. P40189.2.

An "IL-6 aptamer" is an aptamer that is capable of binding to and modifying the activity of IL-6. In some embodiments, an IL-6 aptamer inhibits at least one activity of IL-6 in vitro. In some embodiments, an IL-6 aptamer inhibits at least one activity of IL-6 in vivo. Nonlimiting exemplary activities of IL-6 include binding to IL-6 receptor, inducing cell proliferation (such as TF-1 cell proliferation in vitro), inducing STAT3 phosphorylation, and inducing STAT3-mediated transcription.

As utilized herein, the term "pharmaceutically acceptable" means approved by a regulatory agency of a federal or a state government or listed in the U.S. Pharmacopoeia or other generally recognized pharmacopoeia for use in animals and, more particularly, in humans. The term "carrier" refers to a diluent, adjuvant, excipient, or vehicle with which the therapeutic is administered and includes, but is not limited to, such sterile liquids as water and oils.

A "pharmaceutically acceptable salt" or "salt" of an IL-6 aptamer is a product of the disclosed compound that contains an ionic bond and is typically produced by reacting the disclosed compound with either an acid or a base, suitable for administering to an individual. A pharmaceutically acceptable salt can include, but is not limited to, acid addition salts including hydrochlorides, hydrobromides, phosphates, sulphates, hydrogen sulphates, alkylsulphonates, arylsulphonates, arylalkylsulfonates, acetates, benzoates, citrates, maleates, fumarates, succinates, lactates, and tartrates; alkali metal cations such as Li, Na, K, alkali earth metal salts such as Mg or Ca, or organic amine salts.

A "pharmaceutical composition" is a formulation comprising an IL-6 aptamer in a form suitable for administration to an individual. A pharmaceutical composition is typically formulated to be compatible with its intended route of administration. Examples of routes of administration include, but are not limited to, oral and parenteral, e.g., intravenous, intradermal, subcutaneous, inhalation, topical, transdermal, transmucosal, and rectal administration.

As used herein, the term "therapeutically effective amount" generally means the amount necessary to ameliorate at least one symptom of a disorder or condition to be prevented, reduced, or treated as described herein. The phrase "therapeutically effective amount" as it relates to the IL-6 aptamers of the present disclosure means the aptamer dosage that provides the specific pharmacological response for which the aptamer is administered in a significant number of individuals in need of such treatment. It is emphasized that a therapeutically effective amount of an aptamer that is administered to a particular individual in a particular instance will not always be effective in treating the conditions/diseases described herein, even though such dosage is deemed to be a therapeutically effective amount by those of skill in the art.

The terms "SELEX" and "SELEX process" are used interchangeably herein to refer generally to a combination of (1) the selection of nucleic acids that interact with a target molecule in a desirable manner, for example binding with high affinity to a protein, with (2) the amplification of those selected nucleic acids. The SELEX process can be used to identify aptamers with high affinity to a specific target molecule.

SELEX generally includes preparing a candidate mixture of nucleic acids, binding of the candidate mixture to the desired target molecule to form an affinity complex, separating the affinity complexes from the unbound candidate nucleic acids, separating and isolating the nucleic acid from the affinity complex, purifying the nucleic acid, and identifying a specific aptamer sequence. The process may include multiple rounds to further refine the affinity of the selected aptamer. The process can include amplification steps at one or more points in the process. See, e.g., U.S. Pat. No. 5,475,096, entitled "Nucleic Acid Ligands." The SELEX process can be used to generate an aptamer that covalently binds its target as well as an aptamer that non-covalently binds its target. See, e.g., U.S. Pat. No. 5,705,337 entitled "Systematic Evolution of Nucleic Acid Ligands by Exponential Enrichment: Chemi-SELEX."

The SELEX process can be used to identify high-affinity aptamers containing modified nucleotides that confer improved characteristics on the aptamer, such as, for example, improved in vivo stability or improved delivery characteristics. Examples of such modifications include chemical substitutions at the ribose and/or phosphate and/or base positions. SELEX process-identified aptamers containing modified nucleotides are described in U.S. Pat. No. 5,660, 985, entitled "High Affinity Nucleic Acid Ligands Containing Modified Nucleotides," which describes oligonucleotides containing nucleotide derivatives chemically modified at the C5 and/or 2'-positions of pyrimidines. U.S. Pat. No. 5,580, 737, see supra, describes highly specific aptamers containing one or more nucleotides modified with 2'-amino (2'—$NH_2$), 2'-fluoro (2'-F), and/or 2'-O-methyl (2'-OMe). See also, U.S. Patent Application Publication No. 20090098549, entitled "SELEX and PHOTOSELEX," which describes nucleic acid libraries having expanded physical and chemical properties and their use in SELEX and photoSELEX.

U.S. Provisional Application Ser. No. 61/264,545, filed Nov. 25, 2009, entitled "Nuclease Resistant Oligonucleotides," describes methods for producing oligonucleotides with improved nuclease resistance. The nuclease resistant oligonucleotides include at least one pyrimidine modified at the C-5 position with a group selected from those set forth in FIG. 20 and FIG. 24. In various embodiments, the modifications include substitution of deoxyuridine at the C-5 position with a substituent independently selected from: benzylcarboxyamide (Bn), phenethyl (Pe), thiophenylmethyl (Th), naphthylmethylcarboxyamide (Nap), tryptaminocarboxyamide (Trp), and isobutylcarboxyamide as illustrated above.

SELEX can also be used to identify aptamers that have desirable off-rate characteristics. See U.S. Pat. No. 7,947,447, entitled "Method for Generating Aptamers with Improved Off-Rates," which describes improved SELEX methods for generating aptamers that can bind to target molecules. Methods for producing aptamers having slower rates of dissociation from their respective target molecules are described. The methods involve contacting the candidate mixture with the target molecule, allowing the formation of nucleic acid-target complexes to occur, and performing a slow off-rate enrichment process wherein nucleic acid-target complexes with fast dissociation rates dissociate and do not reform, while complexes with slow dissociation rates remain intact. Additionally, the methods include the use of modified nucleotides in the production of candidate nucleic acid mixtures to generate aptamers with improved off-rate performance (see U.S. Patent Publication No. 2009/0098549, entitled "SELEX and PhotoSELEX"). (See also U.S. Pat. No. 7,855,054 and U.S. Patent Publication No. 2007/0166740). Each of these applications is incorporated herein by reference in its entirety.

In some embodiments, methods of selecting aptamers that bind to a target molecule are provided, comprising: (a) preparing a candidate mixture of nucleic acids, wherein the candidate mixture comprises modified nucleic acids in which at least one pyrimidine in at least one, or in each, nucleic acid of the candidate mixture is chemically modified at the C5-position; (b) contacting the candidate mixture with a target molecule, wherein nucleic acids having an increased affinity to the target molecule relative to other nucleic acids in the candidate mixture bind the target molecule, forming nucleic acid-target molecule complexes; (c) partitioning the increased affinity nucleic acids from the remainder of the candidate mixture; and (d) amplifying the increased affinity nucleic acids to yield a mixture of nucleic acids enriched in nucleic acid sequences that are capable of binding to the target molecule with increased affinity, whereby an aptamer to the target molecule is identified. In certain embodiments, the method further includes performing a slow off-rate enrichment process.

"Target" or "target molecule" or "target" refers herein to any compound upon which a nucleic acid can act in a desirable manner. A target molecule can be a protein, peptide, nucleic acid, carbohydrate, lipid, polysaccharide, glycoprotein, hormone, receptor, antigen, antibody, virus, pathogen, toxic substance, substrate, metabolite, transition state analog, cofactor, inhibitor, drug, dye, nutrient, growth factor, cell, tissue, any portion or fragment of any of the foregoing, etc., without limitation. Virtually any chemical or biological effector may be a suitable target. Molecules of any size can serve as targets. A target can also be modified in certain ways to enhance the likelihood or strength of an interaction between the target and the nucleic acid. A target can also include any minor variation of a particular compound or molecule, such as, in the case of a protein, for example, minor variations in amino acid sequence, disulfide bond formation, glycosylation, lipidation, acetylation, phosphorylation, or any other manipulation or modification, such as conjugation with a labeling component, which does not substantially alter the identity of the molecule. A "target molecule" or "target" is a set of copies of one type or species of molecule or multimolecular structure that is capable of binding to an aptamer. "Target molecules" or "targets" refer to more than one such set of molecules. Embodiments of the SELEX process in which the target is a peptide are described in U.S. Pat. No. 6,376,190, entitled "Modified SELEX Processes Without Purified Protein."

Exemplary IL-6 Aptamers

The IL-6 aptamers of the instant disclosure were identified using an improved SELEX method for identifying aptamers having slow off-rates, as described in Example 1. A random DNA library composed of Bn-dU (5-(N-benzylcarboxyamide-2'-deoxyuridine), dA, dC and dG was used for one selection, and a random DNA library composed of NapdU (5-(N-naphthylcarboxyamide-2'-deoxyuridine), dA, dC and dG was used for another selection. Thus, in various embodiments, an IL-6 aptamer of the invention comprises at least one modified pyrimidine.

Using Bn-dU aptamer 2573-20, studies were conducted to identify a truncated sequence that maintains strong affinity for IL-6. Systematic truncation from the 5' and 3' ends led to identification of a 32 nucleotide sequence (2573-20_15; SEQ ID NO: 22). Using Nap-dU aptamer 2574-49 (SEQ ID NO: 8), similar studies were conducted to identify a truncated sequence that maintains strong affinity for IL-6. Systematic truncation from the 5' and 3' ends led to identification of a 30 nucleotide sequence (2574-49_14; SEQ ID NO: 35).

Furthermore, nucleotide substitution studies described in Example 15 demonstrated that many of the positions in aptamer 2573-20_136 (SEQ ID NO: 101) and aptamer 2574-49_260 (SEQ ID NO: 400) could be modified and/or replaced with little or no loss of IL-6 binding activity. Thus, in some embodiments, an IL-6 aptamer comprises the sequence:

I.

(SEQ ID NO: 700)
5'-GGCAGGZZZGGZQ$_a$GZGG-3';

wherein each Z is independently selected from U, T, and a modified pyrimidine (such as a 5'-modified pyrimidine); each Q is independently selected from a linker, a modified nucleotide, and an unmodified nucleotide; a is 1 to 50. In some embodiments, a is 2 to 50, 1 to 40, 2 to 40, 1 to 30, 2 to 30, 1 to 20, 2 to 20, 1 to 15, 2 to 15, 1 to 10, 2 to 10, 1 to 5, or 2 to 5. In some embodiments, each Q is independently selected from a substituted or unsubstituted $C_2$-$C_{20}$ linker, an alkylene glycol, and a polyalkylene glycol. In some embodiments, each Q is independently selected from a substituted or unsubstituted $C_2$-$C_{20}$ linker, a 1,3-propane diol, a poly(1,3-propane diol) having from 2 to 100 1,3-propane diol units, an ethylene glycol, and a polyethylene glycol having from 2 to 100 ethylene glycol units. In some embodiments, each Z is independently selected from U, T, and the modified pyrimidines shown in FIG. 20. In some embodiments, each Z is independently selected from U, T, and the modified pyrimidines shown in FIG. 24. In some embodiments, one or more nucleotides of the IL-6 aptamer comprises a 2'-O-methyl modification. In some embodiments, one or more of the internucleoside linkages in the IL-6 aptamer is a phosphorothioate linkage.

In some embodiments, an IL-6 aptamer comprises the sequence:

II.
(SEQ ID NO: 701)
5'-GGGYXAXGYAGCL$_b$GZGCGYAAGGCGGY-3' wherein each Z is independently selected from U, T, and a modified pyrimidine (such as a 5'-modified pyrimidine); each Y is independently selected from a modified pyrimidine (such as a 5'-modified pyrimidine); each X is independently selected from a modified pyrimidine (such as a 5'-modified pyrimidine); each L is independently selected from a linker, a modified nucleotide, and an unmodified nucleotide; b is 1 to 20. In some embodiments, b is 1 to 15, 1 to 12, 1 to 10, 1 to 9, 1 to 8, or 1 to 7. In some embodiments, each L is independently selected from a substituted or unsubstituted $C_2$-$C_{20}$ linker, an alkylene glycol, and a polyalkylene glycol. In some embodiments, each L is independently selected from a substituted or unsubstituted $C_2$-$C_{20}$ linker, a 1,3-propane diol, a poly(1,3-propane diol) having from 2 to 100 1,3-propane diol units, an ethylene glycol, and a polyethylene glycol having from 2 to 100 ethylene glycol units. In some embodiments, each L is a $C_3$ linker and b is 2. In some embodiments, each L is independently a modified or unmodified nucleotide and b is 1 to 10. In some embodiments, each Z is independently selected from U, T, and the modified pyrimidines shown in FIG. 20. In some embodiments, each Z is independently selected from U, T, and the modified pyrimidines shown in FIG. 24. In some embodiments, each Y is independently selected from the modified pyrimidines shown in FIG. 20. In some embodiments, each Y is independently selected from the modified pyrimidines shown in FIG. 24. In some embodiments, each X is independently selected from the aromatic modified pyrimidines shown in FIG. 20. In some embodiments, each X is independently selected from the aromatic modified pyrimidines shown in FIG. 24. In some embodiments, each X is independently selected from Nap, 2Nap, NE, BF, and BT in FIG. 24. In some embodiments, each X is Nap. In some embodiments, L is a $C_3$ linker and b is 2. In some embodiments, one or more nucleotides of the IL-6 aptamer comprises a 2'-O-methyl modification. In some embodiments, one or more of the internucleoside linkages in the IL-6 aptamer is a phosphorothioate linkage.

Additional sequencing studies were conducted on the sequence pool from which 2573-20 (SEQ ID NO: 7) was selected. 454 sequencing, which is a large-scale, high throughput method that uses parallel pyrosequencing, provides unbiased sample preparation and very accurate sequence analysis. The sequencing data was used to identify a consensus motif involved in IL-6 binding. A conserved G-quartet motif was identified in many members of the final SELEX pool. From the sequences described in Example 14 and FIG. 23, and the crystal structure in Example 13, a consensus motif was identified for binding to IL-6, which comprises a G-quartet in which two pairs of Gs flank three U, T, or 5'-modified U nucleotides (i.e., GGZZZGG, wherein each Z is independently selected from U, T, and a 5'-modified pyrimidine). Thus, in some embodiments, an IL-6 aptamer comprises a G quartet motif. In some embodiments, an IL-6 aptamer comprises a G quartet motif selected from:

III.
(SEQ ID NO: 702)
5'-GG-ZZZ-GG-Q$_a$-GG-Q$_b$-GG-3';

IV.
(SEQ ID NO: 703)
5'-GG-Q$_a$-GG-ZZZ-GG-Q$_b$-GG-3';
and

V.
(SEQ ID NO: 704)
5'-GG-Q$_a$-GG-Q$_b$-GG-ZZZ-GG-3';

wherein each Z is independently selected from U, T, and a modified pyrimidine (such as a 5'-modified pyrimidine); each Q is independently selected from a linker, a modified nucleotide, and an unmodified nucleotide; a is 1 to 50; and b is 1 to 50. In some embodiments, a is 2 to 50, 1 to 40, 2 to 40, 1 to 30, 2 to 30, 1 to 20, 2 to 20, 1 to 15, 2 to 15, 1 to 10, 2 to 10, 1 to 5, or 2 to 5. In some embodiments, b is 2 to 50, 1 to 40, 2 to 40, 1 to 30, 2 to 30, 1 to 20, 2 to 20, 1 to 15, 2 to 15, 1 to 10, 2 to 10, 1 to 5, or 2 to 5. In some embodiments, each Q is independently selected from a substituted or unsubstituted $C_2$-$C_{20}$ linker, an alkylene glycol, and a polyalkylene glycol. In some embodiments, each Q is independently selected from a substituted or unsubstituted $C_2$-$C_{20}$ linker, a 1,3-propane diol, a poly(1,3-propane diol) having from 2 to 100 1,3-propane diol units, an ethylene glycol, and a polyethylene glycol having from 2 to 100 ethylene glycol units. In some embodiments, at least one or at least two Z nucleotides are independently selected from modified pyrimidines. In some embodiments, at least one or at least two Z nucleotides are independently selected from the modified pyrimidines in FIG. 20. In some embodiments, at least one or at least two Z nucleotides are independently selected from the modified pyrimidines in FIG. 24.

The 454 sequencing of the Nap SELEX pool identified a group of unique sequences that shared two conserved motifs. See FIG. 25. The motifs were found to be in either order (compare, e.g., 2574-49 (SEQ ID NO: 8) to 2574-104 (SEQ ID NO: 705)). In some embodiments, an IL-6 aptamer comprises a sequence selected from:

VI.
(SEQ ID NO: 706)
5'-YXAXGYARQ$_a$MGYAAGSCGRY-3';
or

VII.
(SEQ ID NO: 707)
5'-MGYAAGSCGRYQ$_b$YXAXGYAR-3';

wherein each Y is independently selected from a modified pyrimidine (such as a 5'-modified pyrimidine); each X is independently selected from a modified pyrimidine (such as a 5'-modified pyrimidine); M is selected from C and A; S is selected from C and G; each R is independently selected from G and A; each Q is independently selected from a linker, a modified nucleotide, and an unmodified nucleotide; a is 1 to 30; and b is 1 to 30. In some embodiments, a is 1 to 20, 1 to 10, 4 to 10, or 6 to 7. In some embodiments, b is 1 to 20 or 1 to 17. In some embodiments, each Q is independently selected from a substituted or unsubstituted $C_2$-$C_{20}$ linker, an alkylene glycol, and a polyalkylene glycol. In some embodiments, each Q is independently selected from a substituted or unsubstituted $C_2$-$C_{20}$ linker, a 1,3-propane diol, a poly(1,3-propane diol) having from 2 to 100 1,3-propane diol units, an ethylene glycol, and a polyethylene glycol having from 2 to 100 ethylene glycol units. In some embodiments, each Y is independently selected from the modified pyrimidines shown in FIG. 20. In some embodiments, each Y is independently selected from the modified pyrimidines shown in FIG. 24. In some embodiments, each X is independently selected from the aromatic modified pyrimidines shown in FIG. 20. In some embodiments, each X is independently selected from the aromatic modified pyrimidines shown in FIG. 24. In some embodiments, each X is independently selected from Nap, 2Nap, NE, BF, and BT in FIG. 24. In some embodiments, each X is Nap. In some embodiments, each N is independently selected from A, C, and G. In some embodiments, L is a $C_3$ linker and b is 2. In some embodiments, one or more nucleotides of the IL-6 aptamer comprises a 2'-O-methyl modification. In some embodiments, one or more of the internucleoside linkages in the IL-6 aptamer is a phosphorothioate linkage.

In some embodiments, each X, Y, and/or Z is a modified uridine. In some embodiments, each X, Y, and/or Z is independently selected from the C-5 modified pyrimidines as defined herein. In some embodiments, each X, Y, and/or Z is independently selected from 5-(N-benzylcarboxyamide)-2'-deoxyuridine (BndU), 5-(N-benzylcarboxyamide)-2'-O-methyluridine, 5-(N-benzylcarboxyamide)-2'-fluorouridine, 5-(N-phenethylcarboxyamide)-2'-deoxyuridine (PedU), 5-(N-thiophenylmethylcarboxyamide)-2'-deoxyuridine (ThdU), 5-(N-isobutylcarboxyamide)-2'-deoxyuridine (iBudU), 5-(N-isobutylcarboxyamide)-2'-O-methyluridine, 5-(N-isobutylcarboxyamide)-2'-fluorouridine, 5-(N-tryptaminocarboxyamide)-2'-deoxyuridine (TrpdU), 5-(N-tryptaminocarboxyamide)-2'-O-methyluridine, 5-(N-tryptaminocarboxyamide)-2'-fluorouridine, 5-(N-[1-(3-trimethylamonium) propyl]carboxyamide)-2'-deoxyuridine chloride, 5-(N-naphthylmethylcarboxyamide)-2'-deoxyuridine (NapdU), 5-(N-naphthylmethylcarboxyamide)-2'-O-methyluridine, 5-(N-naphthylmethylcarboxyamide)-2'-fluorouridine, and 5-(N-[1-(2,3-dihydroxypropyl)] carboxyamide)-2'-deoxyuridine). In some embodiments, each Z is 5-(N-benzylcarboxyamide)-2'-deoxyuridine (BndU).

In certain embodiments, portions of the IL-6 aptamer (Y) may not be necessary to maintain binding and certain portions of the contiguous IL-6 aptamer can be modified including, but not limited to replacement with a spacer or linker moiety. In these embodiments, for example, Y can be represented as Y'-Q-Y''-Q'-Y''', wherein Y', Y'' and Y''' are parts of an IL-6 aptamer or segments of different IL-6 aptamers and Q and/or Q' are spacers or linker molecules that modify certain nucleic acid features of the original IL-6 aptamer. When Q and Q' are not present, Y', Y'', and Y''' represent one contiguous IL-6 aptamer (Y).

As used herein a "linker" is a molecular entity that connects two or more molecular entities through covalent bond or non-covalent interactions, and can allow spatial separation of the molecular entities in a manner that preserves the functional properties of one or more of the molecular entities. A linker can also be known as a spacer. Appropriate linker sequences will be readily ascertained by those of skill in the art based upon the present disclosure.

As used herein, a linker can comprise one or more molecules or sub-components, selected from the group including, but not limited to a polynucleotide, a polypeptide, a peptide nucleic acid, a locked nucleic acid, an oligosaccharide, a polysaccharide, an antibody, an affybody, an antibody mimic, an aliphatic, aromatic or heteroaromatic carbon molecule, alkylene glycol (e.g., ethylene glycol, 1,3-propane diol), a polyalkylene glycol (e.g., polyethylene glycol (PEG)), a cell receptor, a ligand, a lipid, any fragment or derivative of these structures, any combination of the foregoing, or any other chemical structure or component.

More specifically, as used herein a linker or spacer may be a backbone comprising a chain of 2 to 20 carbon atoms ($C_2$-$C_{20}$) (saturated, unsaturated, straight chain, branched or cyclic), 0 to 10 aryl groups, 0 to 10 heteroaryl groups, and 0 to 10 heterocyclic groups, optionally comprising an ether (—O—) linkage, (e.g., one or more alkylene glycol units, including but not limited to one or more ethylene glycol units —O—($CH_2CH_2O$)—; one or more 1,3-propane diol units- O—($CH_2CH_2CH_2O$)—, etc.; in some embodiments, a linker comprises 1 to 100 units, 1 to 50 units, 1 to 40 units, 1 to 30 units, 1 to 20 units, 1 to 12 units, or 1 to 10 units); an amine (—NH—) linkage; an amide (—NC(O)—) linkage; and a thioether (—S—) linkage; etc.; wherein each backbone carbon atom may be independently unsubstituted (i.e., comprising —H substituents) or may be substituted with one or more groups selected from a $C_1$ to $C_3$ alkyl, —OH, —$NH_2$, —SH, —O—($C_1$ to $C_6$ alkyl), —S—($C_1$ to $C_6$ alkyl), halogen, —OC (O)($C_1$ to $C_6$ alkyl), —NH—($C_1$ to $C_6$ alkyl), and the like. In some embodiments, a $C_2$-$C_{20}$ linker is a $C_2$-$C_8$ linker, a $C_2$-$C_6$ linker, a $C_2$-$C_5$ linker, a $C_2$-$C_4$ linker, or a $C_3$ linker, wherein each carbon may be independently substituted as described above.

In some embodiments, one or more nucleosides of an IL-6 aptamer comprise a modification selected from a 2'-position sugar modification (such as a 2'-amino (2'—$NH_2$), a 2'-fluoro (2'-F), or a 2'-O-methyl (2'-OMe)), a modification at a cytosine exocyclic amine, a internucleoside linkage modification, and a 5-methyl-cytosine. In some embodiments, an IL-6 aptamer comprises a 3' cap, a 5' cap, and/or an inverted deoxythymidine at the 3' terminus.

In some embodiments, L may be a linker such as an 18-atom hexaethylene glycol linker. In some embodiments, the L may be a combination of nucleotides and a linker. In some embodiments, an IL-6 aptamer has a sequence selected from the sequences of SEQ ID NOs: 7, 8, 11, 19 to 22, 26 to 39, 100 to 239, 300 to 356, 400 to 446, 500 to 572, and 599 to 625. In some embodiments, an IL-6 aptamer has a sequence selected from the sequences of SEQ ID NOs: 7, 8, 11, 19 to 22, 26 to 39, 100 to 239, 400 to 446, and 599 to 625. In some embodiments, an IL-6 aptamer has a sequence that is at least 80%, at least 85%, at least 90%, at least 91%, at least 92%, at least 93%, at least 94%, at least 95%, at least 96%, at least 97%, at least 98%, at least 99%, or 100% identical to a sequence selected from SEQ ID NOs: 7, 8, 11, 19 to 22, 26 to 39, 100 to 239, 300 to 356, 400 to 446, 500 to 572, and 599 to 625. In some embodiments, an IL-6 aptamer has a sequence is at least 80%, at least 85%, at least 90%, at least 91%, at least 92%, at least 93%, at least 94%, at least 95%, at least 96%, at least 97%, at least 98%, at least 99%, or 100% identical to a sequence selected from SEQ ID NOs: 7, 8, 11, 19 to 22, 26 to 39, 100 to 239, 400 to 446, and 599 to 625. The sequence identity to at least one nucleotide sequence shown in SEQ ID NOs: 7, 8, 11, 19 to 22, 26 to 39, 100 to 239, 300 to 356, 400 to 446, 500 to 572, and 599 to 625 is not particularly limited as long as the aptamer specifically binds IL-6 with affinity ($K_d$) less than 10 nM and/or has IL-6 antagonist activity ($IC_{50}$) of less than 10 nM.

The terms "sequence identity", "percent sequence identity", "percent identity", "% identical", "% identity", and variations thereof, when used in the context of two nucleic acid sequences, are used interchangeably to refer to the number of nucleotide bases that are the same in a query nucleic acid or a portion of a query nucleic acid, when it is compared and aligned for maximum correspondence to a reference nucleic acid, divided by either (1) the number of nucleotide bases in the query sequence between and including the most 5' corresponding (i.e., aligned) nucleotide base and the most 3' corresponding (i.e., aligned) nucleotide base, or (2) the total length of the reference sequence, whichever is greater. Exemplary alignment of sequences for comparison can be conducted, e.g., by the local homology algorithm of Smith and Waterman, Adv. Appl. Math., 2:482, 1981, by the homology alignment algorithm of Needleman and Wunsch, J. Mol. Biol., 48:443, 1970, by the search for similarity method of Pearson and Lipman, Proc. Nat'l. Acad. Sci. USA 85:2444, 1988, by computerized implementations of these algorithms (GAP, BESTFIT, FASTA, and TFASTA in the Wisconsin Genetics Software Package, Genetics Computer Group, 575 Science Dr., Madison, Wis.), or by visual inspection (see generally, Ausubel, F. M. et al., Current Protocols in Molecular Biology, pub. by Greene Publishing Assoc. and Wiley-Interscience (1987)).

One example of an algorithm that is suitable for determining percent sequence identity is the algorithm used in the basic local alignment search tool (hereinafter "BLAST"), see, e.g. Altschul et al., J. Mol. Biol. 215:403-410, 1990 and Altschul et al., Nucleic Acids Res., 15:3389-3402, 1997. Software for performing BLAST analyses is publicly available through the National Center for Biotechnology Information (hereinafter "NCBI"). The default parameters used in determining sequence identity using the software available from NCBI, e.g., BLASTN (for nucleotide sequences) are described in McGinnis et al., Nucleic Acids Res., 32:W20-W25, 2004.

As used herein, when describing the percent identity of a nucleic acid, such as an IL-6 aptamer, the sequence of which is at least, for example, about 95% identical to a reference nucleotide sequence, it is intended that the nucleic acid sequence is identical to the reference sequence except that the nucleic acid sequence may include up to five point mutations per each 100 nucleotides of the reference nucleic acid sequence. In other words, to obtain a desired nucleic acid sequence, the sequence of which is at least about 95% identical to a reference nucleic acid sequence, up to 5% of the nucleotides in the reference sequence may be deleted or substituted with another nucleotide, or some number of nucleotides up to 5% of the total number of nucleotides in the reference sequence may be inserted into the reference sequence (referred to herein as an insertion). These mutations of the reference sequence to generate the desired sequence may occur at the 5' or 3' terminal positions of the reference nucleotide sequence or anywhere between those terminal positions, interspersed either individually among nucleotides in the reference sequence or in one or more contiguous groups within the reference sequence. Further, it is intended that a nucleotide base is considered "identical" for the purposes of determining percent identity, when the nucleotide base (1) is the same as the nucleotide base in the reference sequence, or (2) is derived from the nucleotide base in the reference sequence, or (3) is derived from the same nucleotide base from which the nucleotide base in the reference sequence is derived. For example, 5-methyl cytosine is considered to be "identical" to cytosine for the purposes of calculating percent identity. Similarly, the modified uridines shown in FIG. 20 and FIG. 24 are considered to be identical to one another for the purpose of determining percent identity. In some embodiments, the reference sequence may be any one of the nucleotide sequences shown in SEQ ID NOs: 7, 8, 11, 19 to 22, 26 to 39, 100 to 239, 400 to 446, and 599 to 625. In some embodiments, the reference sequence may be any one of the nucleotide sequences shown in SEQ ID NOs: 7, 8, 11, 19 to 22, 26 to 39, 100 to 239, 300 to 356, 400 to 446, 500 to 572, and 599 to 625.

In some embodiments, an IL-6 aptamer comprises a nucleotide sequence shown in any one of SEQ ID NOs: 7, 8, 11, 19 to 22, 26 to 39, 100 to 239, 300 to 356, 400 to 446, 500 to 572, and 599 to 625, wherein 1 to 20, 1 to 15, 1 to 12, 1 to 8, 1 to 5, or 1 to 3 nucleotides are substituted, deleted, or inserted. The number of nucleotides substituted, deleted, or inserted is not particularly limited as long as the aptamer specifically binds IL-6 with affinity ($K_d$) of less than 20 nM and/or has IL-6 antagonist activity ($IC_{50}$) of less than 10 nM ($10^{-8}$ M). In some embodiments, the IL-6 aptamer comprises not more than 10, and in some embodiments, 4, 3, 2, or 1, nucleotide substitutions, deletions, and/or insertions relative to a sequence of any one of SEQ ID NOs: 7, 8, 11, 19 to 22, 26 to 39, 100 to 239, 300 to 356, 400 to 446, 500 to 572, and 599 to 625.

In some embodiments, the present disclosure provides an IL-6 aptamer that, upon binding IL-6, modulates an IL-6 function. In some embodiments, an IL-6 aptamer described herein inhibits IL-6-mediated phosphorylation of STAT3. In various embodiments, the aptamer modulates an IL-6 function in vivo, such as inhibiting IL-6-mediated STAT3 phosphorylation in vivo. In various embodiments, the IL-6 aptamer has a sequence selected from SEQ ID NOs: 7, 8, 11, 19 to 22, 26 to 39, 100 to 239, 300 to 356, 400 to 446, 500 to 572, and 599 to 625. In various embodiments, the IL-6 aptamer is selected from certain aptamers shown in Tables 2 to 4, 10 to 13, and FIGS. 23 and 25 (e.g., SEQ ID NOs: 7, 8, 11, 19 to 22, 26 to 39, 100 to 239, 300 to 356, 400 to 446, 500 to 572, and 599 to 625). In various embodiments, the IL-6 aptamer is selected from the aptamers shown in Tables 2, 10, or 12, or FIG. 23 or 25, or the aptamers of Tables 3 and 4 that specifically bind IL-6 with an affinity ($K_d$) of less than 20 nM. In various embodiments, the IL-6 aptamer has a sequence selected from SEQ ID NOs: 7, 8, 11, 19 to 22, 26 to 39, 100 to 239, 400 to 446, and 599 to 625. In some embodiments, the IL-6 aptamer comprises 12 to 80, or 20 to 80, or 25 to 80, or 30 to 80 contiguous nucleotides of an aptamer selected from certain aptamers shown in Tables 2 to 4, 10 to 13, and FIGS. 23 and 25 (e.g., SEQ ID NOs: 7, 8, 11, 19 to 22, 26 to 39, 100 to 239, 300 to 356, 400 to 446, 500 to 572, and 599 to 625), wherein the aptamer specifically binds IL-6 with an affinity (Kd) of less than 20 nM and/or has IL-6 antagonist activity (IC50) of less than 10 nM ($10^{-8}$ M). In some embodiments, the IL-6 aptamer comprises at least 12, at least 13, at least 14, at least 15, at least 16, at least 17, at least 18, at least 19, at least 20, at least 21, at least 21, at least 22, at least 23, at least 24, at least 25, at least 26, at least 27, at least 28, at least 29, or at least 30 contiguous nucleotides of an aptamer selected from certain aptamers shown in Tables 2 to 4, 10 to 13, and FIGS. 23 and 25 (e.g., SEQ ID NOs: 7, 8, 11, 19 to 22, 26 to 39, 100 to 239, 300 to 356, 400 to 446, 500 to 572, and 599 to 625), wherein the aptamer specifically binds IL-6 with an affinity (Kd) of less than 20 nM and/or has IL-6 antagonist activity (IC50) of less than 10 nM ($10^{-8}$ M). In some embodiments, an IL-6 aptamer consists of at least 12, at least 13, at least 14, at least 15, at least 16, at least 17, at least 18, at least 19, at least 20, at least 21, at least 21, at least 22, at least 23, at least 24, at least 25, at least 26, at least 27, at least 28, at least 29, or at least 30 contiguous nucleotides that are identical in nucleobase sequence to a sequence selected from SEQ ID NOS: 7, 8, 11, 19 to 22, 26 to 39, 100 to 239, 300 to 356, 400 to 446, 500 to 572, and 599 to 625, wherein the aptamer specifically binds IL-6 with an affinity (Kd) of less than 20 nM and/or has IL-6 antagonist activity (IC50) of less than 10 nM ($10^{-8}$ M).

In some embodiments, the IL-6 aptamer comprises 12 to 80, or 20 to 80, or 25 to 80, or 30 to 80 contiguous nucleotides of certain aptamers selected from the aptamers shown in Tables 2 to 4, 10, 12, and FIGS. 23 and 25 (e.g., SEQ ID NOs: 7, 8, 11, 19 to 22, 26 to 39, 100 to 239, 400 to 446, and 599 to 625), wherein the aptamer specifically binds IL-6 with an affinity (Kd) of less than 20 nM and/or has IL-6 antagonist activity (IC50) of less than 10 nM ($10^{-8}$ M). In some embodiments, the IL-6 aptamer comprises at least 12, at least 13, at least 14, at least 15, at least 16, at least 17, at least 18, at least 19, at least 20, at least 21, at least 21, at least 22, at least 23, at least 24, at least 25, at least 26, at least 27, at least 28, at least 29, or at least 30 contiguous nucleotides of an aptamer selected from certain aptamers shown in Tables 2 to 4, 10, 12, and FIGS. 23 and 25 (e.g., SEQ ID NOs: 7, 8, 11, 19 to 22, 26 to 39, 100 to 239, 400 to 446, and 599 to 625), wherein the aptamer specifically binds IL-6 with an affinity (Kd) of less than 20 nM and/or has IL-6 antagonist activity (IC50) of less than 10 nM ($10^{-8}$ M). In some embodiments, an IL-6 aptamer consists of at least 12, at least 13, at least 14, at least 15, at least 16, at least 17, at least 18, at least 19, at least 20, at least 21, at least 21, at least 22, at least 23, at least 24, at least 25, at least 26, at least 27, at least 28, at least 29, or at least 30 contiguous nucleotides that are identical in nucleobase sequence to a sequence selected from SEQ ID NOS: 7, 8, 11, 19 to 22, 26 to 39, 100 to 239, 400 to 446, and 599 to 625, wherein the aptamer specifically binds IL-6 with an affinity (Kd) of less than 20 nM and/or has IL-6 antagonist activity (IC50) of less than 10 nM ($10^{-8}$ M).

In some embodiments, the IL-6 aptamer comprises 12 to 80, or 20 to 80, or 25 to 80, or to 80 contiguous nucleotides of an aptamer selected from the aptamers shown in Table 10 or Table 12 (SEQ ID NOs: 100 to 239 and 400 to 446), wherein the aptamer specifically binds IL-6 with an affinity (Kd) of less than 20 nM and/or has IL-6 antagonist activity (IC50) of less than 10 nM ($10^{-8}$ M). In some embodiments, the IL-6 aptamer comprises at least 12, at least 13, at least 14, at least 15, at least 16, at least 17, at least 18, at least 19, at least 20, at least 21, at least 21, at least 22, at least 23, at least 24, at least 25, at least 26, at least 27, at least 28, at least 29, or at least 30 contiguous nucleotides of an aptamer shown in Table 10 or Table 12 (SEQ ID NOs: 100 to 239 and 400 to 446), wherein the aptamer specifically binds IL-6 with an affinity (Kd) of less than 20 nM and/or has IL-6 antagonist activity (IC50) of less than 10 nM ($10^{-8}$ M). In some embodiments, an IL-6 aptamer consists of at least 12, at least 13, at least 14, at least 15, at least 16, at least 17, at least 18, at least 19, at least 20, at least 21, at least 21, at least 22, at least 23, at least 24, at least 25, at least 26, at least 27, at least 28, at least 29, or at least 30 contiguous nucleotides of an aptamer shown in Tables 10 and 12 (SEQ ID NOs: 100 to 239 and 400 to 446), wherein the aptamer specifically binds IL-6 with an affinity (Kd) of less than 20 nM and/or has IL-6 antagonist activity (IC50) of less than 10 nM ($10^{-8}$ M).

In any of the embodiments herein, an IL-6 aptamer may comprise additional nucleotides or other chemical moieties on the 5' end, the 3' end, or both the 5' and the 3' end of the aptamer.

The IL-6 aptamer can contain any number of nucleotides in addition to the IL-6 binding region. In various embodiments, the IL-6 aptamer can include up to about 100 nucleotides, up to about 95 nucleotides, up to about 90 nucleotides, up to about 85 nucleotides, up to about 80 nucleotides, up to about 75 nucleotides, up to about 70 nucleotides, up to about 65 nucleotides, up to about 60 nucleotides, up to about 55 nucleotides, up to about 50 nucleotides, up to about 45 nucleotides, up to about 40 nucleotides, up to about 35 nucleotides, up to about 30 nucleotides, up to about 25 nucleotides, and up to about 20 nucleotides.

In some embodiments, the IL-6 aptamer is selected from an aptamer that has similar binding characteristics and ability to treat IL-6 associated inflammatory diseases, malignant diseases, infections, autoimmune diseases, and other diseases or conditions in which IL-6 has been implicated as an aptamer selected from SEQ ID NOs: 7, 8, 11, 19 to 22, 26 to 39, 100 to 239, 400 to 446, and 599 to 625. In some embodiments, an IL-6 aptamer is provided that binds to the same region of an IL-6 as an aptamer selected from the aptamers shown in any of Tables 2, 10, 12, and FIGS. 23 and 25.

The IL-6 aptamers of the instant invention specifically bind mature IL-6 (SEQ ID NO: 10) (amino acids 29 to 212 of SEQ ID NO: 9; see FIG. 21). In some embodiments, an IL-6 aptamer is provided that binds to the same region of an IL-6 as IL-6 aptamer 2573-20_136 (SEQ ID NO: 101). In some embodiments, an IL-6 aptamer is provided that binds to a region (epitope) of IL-6 comprising amino acids 16 to 31 of the mature protein (SEQ ID NO: 10) (amino acids 44 to 59 of the precursor sequence (SEQ ID NO: 9); see FIG. 21). This region encompasses the interaction surface engaged by "domain 1" of the IL-6 aptamer 2573-20_136 (SEQ ID NO: 101). In some embodiments, an IL-6 aptamer is provided that binds an IL-6 epitope comprising amino acids 16 to 31 and 117 to 125 of the mature protein (SEQ ID NO: 10) (amino acids 44 to 59 and 145 to 153 of the precursor sequence (SEQ ID NO: 9); see FIG. 21). This epitope encompasses the interaction surface engaged by both "domain 1" and "domain 2" of the IL-6 aptamer 2573-20_136 (SEQ ID NO: 101). Polar contacts are defined as the sum of the sum of hydrogen bonds and charge-charge interactions. In some embodiments, an IL-6 aptamer is provided that binds to IL-6 with a ratio of polar contacts to interface area of less than 0.01, less than 0.009, less than 0.008, or about 0.007.

In some embodiments, an IL-6 aptamer competes for binding to mature IL-6, such as IL-6 comprising the sequence of SEQ ID NO: 10 (see FIG. 21), with IL-6 aptamer 2573-20_136 (SEQ ID NO: 101). In some embodiments, an IL-6 aptamer is provided that binds to the same region of an IL-6 as IL-6 aptamer 2574-49_260 (SEQ ID NO: 400). In some embodiments, an IL-6 aptamer competes for binding to mature IL-6, such as IL-6 comprising the sequence of SEQ ID NO: 10 (see FIG. 21), with IL-6 aptamer 2574-49_260 (SEQ ID NO: 400).

In some embodiments, an IL-6 aptamer is provided that has any combination of the following characteristics:
(a) binds to a region of mature IL-6 (SEQ ID NO: 10) comprising amino acids 16 to 31 of the mature protein;
(b) binds to an epitope of mature IL-6 (SEQ ID NO: 10) comprising amino acids 16 to 31 and 117 to 125 of the mature protein;
(c) competes for binding to mature IL-6 (SEQ ID NO: 10) with IL-6 aptamer 2573-20_136 (SEQ ID NO: 101); and/or (d) binds to mature IL-6 with a ratio of polar contacts to interface area of less than 0.01, less than 0.009, less than 0.008, or about 0.007.

In some embodiments, an IL-6 aptamer has an activity selected from inhibiting IL-6 binding to an IL-6 receptor, inhibiting STAT3 phosphorylation, inhibiting STAT3-driven transcription, and inhibiting IL-6-induced cell proliferation.

The IL-6 aptamer can be selected to have any suitable dissociation constant ($K_d$) for IL-6. In some embodiments, an IL-6 aptamer has a dissociation constant ($K_d$) for IL-6 of less than 30 nM, less than 25 nM, less than 20 nM, less than 15 nM, less than 10 nM, less than 9 nM, less than 8 nM, less than 7 nM, less than 6 nM, less than 5 nM, less than 4 nM, less than 3 nM, less than 2 nM, or less than 1 nM. Dissociation constants may be determined with a binding assay using a multipoint titration and fitting the equation y=(max−min)(Protein)/($K_d$+Protein)+min as described in Example 1, below. In some embodiments, the IL-6 aptamer is an aptamer with a $K_d$ that is less than or equal to the $K_d$ of an aptamer shown in Tables 10 and 12 (SEQ ID NOs: 100 to 239 and 400 to 446). In some embodiments, the IL-6 aptamer is an aptamer with a $K_d$ that is less than or equal to the $K_d$ of IL-6 aptamer 2573-20_136 (SEQ ID NO: 101). In some embodiments, the IL-6 aptamer is an aptamer with a $K_d$ that is less than or equal to the $K_d$ of IL-6 aptamer 2574-49_260 (SEQ ID NO: 400).

In some embodiments, an IL-6 aptamer has IL-6 antagonist activity (IC50) of less than $10^{-8}$ M (<10 nM), less than $10^{-9}$ M, less than $10^{-10}$ M, or less than $10^{-11}$ M. In various embodiments, IL-6 antagonist activity may be determined using, for example, a cell proliferation assay and/or a gene reporter assay (see, e.g., Examples 2 and 11). In an exemplary cell proliferation assay, inhibition of cell growth of IL-6 responsive cells by an IL-6 aptamer is measured. In an exemplary gene reporter assay, IL-6 aptamers are assayed for inhibition of STAT phosphorylation in cells transfected with a STAT gene.

Pharmaceutical Compositions Comprising Aptamers

In some embodiments, pharmaceutical compositions comprising at least one aptamer described herein and at least one pharmaceutically acceptable carrier are provided. Suitable carriers are described in "Remington: The Science and Practice of Pharmacy, Twenty-first Edition," published by Lippincott Williams & Wilkins, which is incorporated herein by reference. Pharmaceutical compositions that include at least one aptamer described herein and at least one pharmaceutically acceptable carrier may also include one or more other active agents.

The aptamers described herein can be utilized in any pharmaceutically acceptable dosage form, including but not limited to injectable dosage forms, liquid dispersions, gels, aerosols, ointments, creams, lyophilized formulations, dry powders, tablets, capsules, controlled release formulations, fast melt formulations, delayed release formulations, extended release formulations, pulsatile release formulations, mixed immediate release and controlled release formulations, etc. Specifically, the aptamers described herein can be formulated: (a) for administration selected from any of oral, pulmonary, intravenous, intra-arterial, intrathecal, intra-articular, rectal, ophthalmic, colonic, parenteral, intracisternal, intravaginal, intraperitoneal, local, buccal, nasal, and topical administration; (b) into a dosage form selected from any of liquid dispersions, gels, aerosols, ointments, creams, tablets, sachets and capsules; (c) into a dosage form selected from any of lyophilized formulations, dry powders, fast melt formulations, controlled release formulations, delayed release formulations, extended release formulations, pulsatile release formulations, and mixed immediate release and controlled release formulations; or (d) any combination thereof.

Solutions or suspensions used for parenteral, intradermal, or subcutaneous application can comprise one or more of the following components: (1) a sterile diluent such as water for injection, saline solution, fixed oils, polyethylene glycols, glycerine, propylene glycol or other synthetic solvents; (2) antibacterial agents such as benzyl alcohol or methyl parabens; (3) antioxidants such as ascorbic acid or sodium bisulfite; (4) chelating agents such as ethylenediaminetetraacetic acid; (5) buffers such as acetates, citrates or phosphates; and (5) agents for the adjustment of tonicity such as sodium chloride or dextrose. The pH can be adjusted with acids or bases, such as hydrochloric acid or sodium hydroxide. A parenteral preparation can be enclosed in ampoules, disposable syringes or multiple dose vials made of glass or plastic.

Pharmaceutical compositions suitable for injectable use may include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL (BASF, Parsippany, N.J.) or phosphate buffered saline (PBS). In all cases, the composition should be sterile and should be fluid to the extent that easy syringability exists. The pharmaceutical composition should be stable under the conditions of manufacture and storage and should be preserved against the contaminating action of microorganisms such as bacteria and fungi. The term "stable", as used herein, means remaining in a state or condition that is suitable for administration to a subject.

The carrier can be a solvent or dispersion medium, including, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as mannitol or sorbitol, and inorganic salts such as sodium chloride in the composition. Prolonged absorption of the injectable compositions can be brought about by including in the composition an agent which delays absorption, for example, aluminum monostearate and gelatin.

Sterile injectable solutions can be prepared by incorporating the active reagent (e.g., an IL-6 aptamer) in an appropriate amount in an appropriate solvent with one or a combination of ingredients enumerated above, as desired, followed by filtered sterilization. Generally, dispersions are prepared by incorporating at least one IL-6 aptamer into a sterile vehicle that contains a basic dispersion medium and any other desired ingredient. In the case of sterile powders for the preparation of sterile injectable solutions, exemplary methods of preparation include vacuum drying and freeze-drying, both of which will yield a powder of an IL-6 aptamer plus any additional desired ingredient from a previously sterile-filtered solution thereof.

Oral compositions generally include an inert diluent or an edible carrier. They can be enclosed, for example, in gelatin capsules or compressed into tablets. For the purpose of oral therapeutic administration, the IL-6 aptamer can be incorporated with excipients and used in the form of tablets, troches, or capsules. Oral compositions can also be prepared using a fluid carrier for use as a mouthwash, wherein the compound in the fluid carrier is applied orally and swished and expectorated or swallowed. Pharmaceutically compatible binding agents, and/or adjuvant materials can be included as part of the composition.

For administration by inhalation, the compounds are delivered in the form of an aerosol spray from a pressured container or dispenser that contains a suitable propellant, e.g., a gas such as carbon dioxide, a nebulized liquid, or a dry powder from a suitable device. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active reagents are formulated into ointments, salves, gels, or creams as generally known in the art. The reagents can also be prepared in the form of suppositories (e.g., with conventional suppository bases such as cocoa butter and other glycerides) or retention enemas for rectal delivery.

In some embodiments, an IL-6 aptamer is prepared with a carrier that will protect against rapid elimination from the body. For example, a controlled release formulation can be used, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. The materials can also be obtained commercially from Alza Corporation and Nova Pharmaceuticals, Inc.

Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811.

Additionally, suspensions of an IL-6 aptamer may be prepared as appropriate oily injection suspensions. Suitable lipophilic solvents or vehicles include fatty oils, such as sesame oil, or synthetic fatty acid esters, such as ethyl oleate, triglycerides, or liposomes. Non-lipid polycationic amino polymers may also be used for delivery. Optionally, the suspension may also include suitable stabilizers or agents to increase the solubility of the compounds and allow for the preparation of highly concentrated solutions.

In some cases, it may be especially advantageous to formulate oral or parenteral compositions in dosage unit form for ease of administration and uniformity of dosage. Dosage unit form as used herein refers to physically discrete units suited as unitary dosages for the subject to be treated; each unit containing a predetermined quantity of an IL-6 aptamer calculated to produce the desired therapeutic effect in association with the required pharmaceutical carrier. The specification for the dosage unit forms of IL-6 aptamers described herein are dictated by and directly dependent on the characteristics of the particular IL-6 aptamer and the particular therapeutic effect to be achieved, and the limitations inherent in the art of compounding such an active agent for the treatment of individuals.

Pharmaceutical compositions comprising at least one IL-6 aptamer can include one or more pharmaceutical excipients. Examples of such excipients include, but are not limited to, binding agents, filling agents, lubricating agents, suspending agents, sweeteners, flavoring agents, preservatives, buffers, wetting agents, disintegrants, effervescent agents, and other excipients. Such excipients are known in the art. Exemplary excipients include: (1) binding agents which include various celluloses and cross-linked polyvinylpyrrolidone, microcrystalline cellulose, such as Avicel® PH101 and Avicel® PH102, silicified microcrystalline cellulose (ProSolv SMCC™), gum tragacanth and gelatin; (2) filling agents such as various starches, lactose, lactose monohydrate, and lactose anhydrous; (3) disintegrating agents such as alginic acid, Primogel, corn starch, lightly crosslinked polyvinyl pyrrolidone, potato starch, maize starch, and modified starches, croscarmellose sodium, cross-povidone, sodium starch glycolate, and mixtures thereof; (4) lubricants, including agents that act on the flowability of a powder to be compressed, include magnesium stearate, colloidal silicon dioxide, such as Aerosil® 200, talc, stearic acid, calcium stearate, and silica gel; (5) glidants such as colloidal silicon dioxide; (6) preservatives, such as potassium sorbate, methylparaben, propylparaben, benzoic acid and its salts, other esters of parahydroxybenzoic acid such as butylparaben, alcohols such as ethyl or benzyl alcohol, phenolic compounds such as phenol, or quaternary compounds such as benzalkonium chloride; (7) diluents such as pharmaceutically acceptable inert fillers, such as microcrystalline cellulose, lactose, dibasic calcium phosphate, saccharides, and/or mixtures of any of the foregoing; examples of diluents include microcrystalline cellulose, such as Avicel® PH101 and Avicel® PH102; lactose such as lactose monohydrate, lactose anhydrous, and Pharmatose® DCL21; dibasic calcium phosphate such as Emcompress®; mannitol; starch; sorbitol; sucrose; and glucose; (8) sweetening agents, including any natural or artificial sweetener, such as sucrose, saccharin sucrose, xylitol, sodium saccharin, cyclamate, aspartame, and acesulfame; (9) flavoring agents, such as peppermint, methyl salicylate, orange flavoring, Magnasweet® (trademark of MAFCO), bubble gum flavor, fruit flavors, and the like; and (10) effervescent agents, including effervescent couples such as an organic acid and a carbonate or bicarbonate. Suitable organic acids include, for example, citric, tartaric, malic, fumaric, adipic, succinic, and alginic acids and anhydrides and acid salts. Suitable carbonates and bicarbonates include, for example, sodium carbonate, sodium bicarbonate, potassium carbonate, potassium bicarbonate, magnesium carbonate, sodium glycine carbonate, L-lysine carbonate, and arginine carbonate. Alternatively, only the sodium bicarbonate component of the effervescent couple may be present.

In various embodiments, the formulations described herein are substantially pure. As used herein, "substantially pure" means the active ingredient (e.g., an IL-6 aptamer) is the predominant species present (i.e., on a molar basis it is more abundant than any other individual species in the composition). In one embodiment, a substantially purified fraction is a composition wherein the active ingredient comprises at least about 50 percent (on a molar basis) of all macromolecular species present. Generally, a substantially pure composition will include more than about 80% of all macromolecular species present in the composition. In various embodiments, a substantially pure composition will include at least about 85%, at least about 90%, at least about 95%, or at least about 99% of all macromolecular species present in the composition. In various embodiments, the active ingredient is purified to homogeneity (contaminant species cannot be detected in the composition by conventional detection methods) wherein the composition consists essentially of a single macromolecular species.

Kits Comprising Aptamers

The present disclosure provides kits comprising any of the IL-6 aptamers described herein. Such kits can comprise, for example, (1) at least one IL-6 aptamer; and (2) at least one pharmaceutically acceptable carrier, such as a solvent or solution. Additional kit components can optionally include, for example: (1) any of the pharmaceutically acceptable excipients identified herein, such as stabilizers, buffers, etc., (2) at least one container, vial or similar apparatus for holding and/or mixing the kit components; and (3) delivery apparatus. Kit components can optionally include, for example (1) labeling agents that can be used to detect a target molecule that is bound to an aptamer, such as a fluorescent molecules, dyes, etc.; (2) a solid support, such as a microarray, bead, etc. and (3) reagents related to quantitation of polymerase chain reaction products, such as intercalating fluorescent dyes or fluorescent DNA probes, etc.

Methods of Treatment

The present disclosure provides methods of preventing or treating (e.g., alleviating one or more symptoms of) medical conditions through the use of an IL-6 aptamer. The methods comprise administering a therapeutically effective amount of an IL-6 aptamer to a subject in need thereof. The described aptamers can also be used for prophylactic therapy. In some embodiments, the IL-6 aptamer is administered intraperitoneally. In some embodiments the IL-6 aptamer is administered orally or intravenously.

The IL-6 aptamer used in methods of treatment can be: (1) an IL-6 aptamer described herein, or a pharmaceutically acceptable salt thereof, or a prodrug thereof.

The individual or subject can be any animal (domestic, livestock or wild), including, but not limited to, cats, dogs, horses, pigs and cattle, and preferably human subjects. As used herein, the terms patient, individual, and subject may be used interchangeably.

As used herein, "treating" describes the management and care of a patient for the purpose of treating a disease, condition, or disorder and includes the administration of an IL-6 aptamer to prevent the onset of the symptoms or complications of a disease, condition or disorder; to alleviate symptoms or complications of the disease, condition, or disorder; or to eliminate the presence of the disease, condition or disorder in the patient. More specifically, "treating" includes reversing, attenuating, alleviating, minimizing, suppressing or halting at least one deleterious symptom or effect of a disease (disorder) state, disease progression, disease causative agent or other abnormal condition. Treatment is generally continued as long as symptoms and/or pathology ameliorate.

In various embodiments, the disclosed compositions and methods are used to prevent, treat, and/or ameliorate inflammatory diseases, malignant diseases, infections, autoimmune diseases, and/or other diseases or conditions in which IL-6 is implicated. Nonlimiting exemplary inflammatory diseases that may be treated with the IL-6 aptamers described herein include rheumatoid arthritis, juvenile idiopathic arthritis, systemic-onset juvenile idiopathic arthritis, osteoarthritis, sepsis, asthma, interstitial lung disease, inflammatory bowel disease, systemic sclerosis, intraocular inflammation, Graves disease, endometriosis, systemic sclerosis, adult-onset still disease, amyloid A amyloidosis, polymyalgia rheumatic, remitting seronegative symmetrical synovitis with pitting edema, Behcet's disease, uveitis, graft-versus-host diseases, and TNFR-associated periodic syndrome. Malignant diseases that may be treated with the IL-6 aptamers described herein include cancers and cancer-related conditions. Nonlimiting exemplary cancers include multiple myeloma, leukemia, pancreatic cancer, breast cancer, colorectal cancer, cachexia, melanoma, cervical cancer, ovarian cancer, lymphoma, gastrointestinal, lung cancer, prostate cancer, renal cell carcinoma, metastatic kidney cancer, solid tumors, non-small cell lung carcinoma, non-Hodgkin's lymphoma, bladder cancer, oral cancer, myeloproliferative neoplasm, B-cell lymphoproliferative disease, and plasma cell leukemia. Nonlimiting exemplary cancer-related conditions include non-small cell lung cancer-related fatigue and cancer related anorexia. Nonlimiting exemplary infections that may be treated with the IL-6 aptamers described herein include human immunodeficiency virus (HIV), human T-lymphotropic virus (HTLV), cerebral malaria, urinary tract infections, and meningococcal infections. Nonlimiting exemplary autoimmune diseases that may be treated with the IL-6 aptamers described herein include systemic lupus erythromatosus, systemic sclerosis, polymyositis, vasculitis syndrome including giant cell arteritis, takayasu aeteritis, cryoglobulinemia, myeloperoxidase-antineutrophilcytoplasmic antibody-associated crescentic glomerulonephritis, rheumatoid vasculitis, Crohn's disease, relapsing polychondritis, acquired hemophilia A, and autoimmune hemolytic anemia. Further diseases that may be treated with the IL-6 aptamers described herein include, but are not limited to, Castleman's disease, ankylosing spondyliytis, coronary heart disease, cardiovascular disease in rheumatoid arthritis, pulmonary arterial hypertension, chronic obstructive pulmonary disease (COPD), atopic dermatitis, psoriasis, sciatica, type II diabetes, obesity, giant cell arteritis, acute graft-versus-host disease (GVHD), non-ST elevation myocardial infarction, anti-neutrophil cytoplasmic antibody (ANCA) associated vasculitis, neuromyelitis optica, chronic glomerulonephritis, and Takayasu arteritis.

In some embodiments, the disclosed compounds or pharmaceutically acceptable salts thereof, or prodrugs, can be administered in combination with other active agents. Compositions including the disclosed IL-6 aptamers may contain, for example, more than one aptamer. In some embodiments, a composition containing one or more IL-6 aptamers is administered in combination with one or more additional agents for preventing, treating, and/or ameliorating inflammatory diseases, malignant diseases, infections, autoimmune diseases, and/or other diseases or conditions in which IL-6 is implicated. Nonlimiting exemplary additional active agents include TNF-α inhibitors, IL-1 inhibitors, IL-23 inhibitors, IFN-γ inhibitors, IL-17 inhibitors, IL-22 inhibitors, IL-4/IL-13 inhibitors, IL-13 inhibitors, IL-5 inhibitors, and JAK inhibitors. Nonlimiting exemplary TNF-α inhibitors include infliximab, adalimumab, golimumab, etanercept, certolizumab, ANO128 (Anacor), ART621 (Arena Therapeutics), and anti-TNF-α nanobody (such as ATN-103, Pfizer). Nonlimiting exemplary IL-1 inhibitors include anakinra, canakinumab, XOMA052 (Xoma), and rilonacept. Nonlimiting exemplary IL-23 inhibitors include urtekinumab, briakinumab, apilimod. A nonlimiting exemplary IFN-γ inhibitor is AMG811 (Amgen). Nonlimiting exemplary IL-17 inhibitors include AIN457 (Novartis), ixekizumab, AMG827 (Amgen), and Rg4934 (Roche). A nonlimiting exemplary IL-22 inhibitor is fezakinumab. Nonlimiting exemplary IL-4/IL-13 inhibitors include AMG317 (Amgen), pitrakinra, Nuvance, and AIR645 (Altair). Nonlimiting exemplary IL-13 inhibitors include anrukinzumab, lebrikizumab, CAT-354 (MedImmune), and IMA-026 (Wyeth). A nonlimiting exemplary IL-5 inhibitor is mepolizumab. Nonlimiting exemplary JAK inhibitors include tofacitib and ruxolitinib.

In general, the currently available dosage forms of the known therapeutic agents for use in such combinations will be suitable.

"Combination therapy" (or "co-therapy") includes the administration of an IL-6 aptamer composition and at least one second agent as part of a specific treatment regimen intended to provide the beneficial effect from the co-action of these therapeutic agents. The beneficial effect of the combination includes, but is not limited to, pharmacokinetic or pharmacodynamic co-action resulting from the combination of therapeutic agents. Administration of these therapeutic agents in combination typically is carried out over a defined time period (usually minutes, hours, days or weeks depending upon the combination selected).

"Combination therapy" may, but generally is not, intended to encompass the administration of two or more of these therapeutic agents as part of separate monotherapy regimens that incidentally and arbitrarily result in the combinations of the present disclosure. "Combination therapy" is intended to embrace administration of these therapeutic agents in a sequential manner, that is, wherein each therapeutic agent is administered at a different time, as well as administration of these therapeutic agents, or at least two of the therapeutic agents, in a substantially simultaneous manner. Substantially simultaneous administration can be accomplished, for example, by administering to the subject a single dose having a fixed ratio of each therapeutic agent or in multiple, single doses for each of the therapeutic agents.

The dosage regimen utilizing the IL-6 aptamers is selected in accordance with a variety of factors, including, for example, type, species, age, weight, sex and medical condition of the subject; the severity of the condition to be treated; the route of administration; the renal and hepatic function of the subject; and the particular aptamer or salts thereof employed. An ordinarily skilled physician or veterinarian can readily determine and prescribe the effective amount of the composition required to prevent, counter or arrest the progress of the condition.

In general, the dosage, i.e., the therapeutically effective amount, ranges from about 1 ng/kg to about 1 g/kg body weight, in some embodiments about 1 µg/kg to about 1 g/kg body weight, in some embodiments about 1 µg/kg to about 100 mg/kg body weight, in some embodiments about 1 µg/kg to about 10 mg/kg body weight of the subject being treated, per day.

Methods for Diagnosing or Detecting

Aptamers capable of binding IL-6, described herein, can be used as diagnostic reagents, either in vitro or in vivo. The IL-6 aptamers and identified herein can be used in any diagnostic, detection, imaging, high throughput screening or target validation techniques or procedures or assays for which aptamers, oligonucleotides, antibodies and ligands, without limitation can be used. For example, IL-6 aptamers and identified herein can be used according to the methods described in detail in U.S. Pat. No. 7,855,054, entitled "Multiplexed Analyses of Test Samples", which is incorporated by reference herein in its entirety.

Aptamers capable of binding IL-6, described herein, can be used in a variety of assays including, assays that use planar arrays, beads, and other types of solid supports. The assays may be used in a variety of contexts including in life science research applications, clinical diagnostic applications, (e.g., a diagnostic test for a disease, or a "wellness" test for preventative healthcare); ALONA and UPS assays, and in vivo imaging applications. For some applications, multiplexed assays employing the described IL-6 aptamers and may be used.

In some embodiments, the IL-6 aptamers may be used as very sensitive and specific reagents for incorporation into a variety of in vitro diagnostic methods or kits. In some embodiments, the IL-6 aptamers are used as substitutes for antibodies in a number of infectious, or other type of, disease detection methods where the aptamer to IL-6 includes either or both a detectable material and an immobilization or capture component. In these embodiments, after the aptamer from the kit is mixed with a clinical specimen, a variety of assay formats may be utilized. In one embodiment, the aptamer also includes a detectable label, such as a fluorophore. In other embodiments, the assay format may include fluorescence quenching, hybridization methods, flow cytometry, mass spectroscopy, inhibition or competition methods, enzyme linked oligonucleotide assays, SPR, evanescent wave methods, etc. In some embodiments, the aptamer is provided in the kit in solution. In other embodiments, the aptamer in the kit is immobilized onto a solid support used in conjunction with the assay for testing the specimen. In various embodiments, the solid support is designed for the detection of one or more targets of interest. In other embodiments, the kit may further include reagents to extract the target of interest, reagents for amplifying the aptamer, reagents for performing washing, detection reagents, etc.

Diagnostic or assay devices, e.g. columns, test strips or biochips, having one or more IL-6 aptamer adhered to a solid surface of the device are also provided. The aptamer(s) may be positioned so as to be capable of binding IL-6 molecules that are contacted with the solid surface to form aptamer-target complexes that remain adhered to the surface of the device, thereby capturing the target and enabling detection and optionally quantitation of the target. An array of aptamers (which may be the same or different) may be provided on such a device.

In one embodiment for detecting IL-6, an aptamer affinity complex or aptamer covalent complex is contacted with a labeling agent that includes a binding partner that is specific for IL-6. The specific binding partner may be any suitable moiety, including an antibody, an antibody fragment, a synthetic antibody mimetic, a biomimetic, an aptamer, a molecular imprinted ligand, and the like. The specific binding partner is conjugated or linked to another labeling agent component, usually, a detectable moiety or label. In one embodiment for detecting IL-6, an aptamer affinity complex or aptamer covalent complex is contacted with a labeling agent that is capable of labeling IL-6, without a binding partner, and comprises a detectable moiety or label.

The detectable moiety or label is capable of being detected directly or indirectly. In general, any reporter molecule that is detectable can be a label. Labels include, for example, (i) reporter molecules that can be detected directly by virtue of generating a signal, (ii) specific binding pair members that may be detected indirectly by subsequent binding to a cognate that contains a reporter molecule, (iii) mass tags detectable by mass spectrometry, (iv) oligonucleotide primers that can provide a template for amplification or ligation, and (v) a specific polynucleotide sequence or recognition sequence that can act as a ligand, such as, for example, a repressor protein, wherein in the latter two instances the oligonucleotide primer or repressor protein will have, or be capable of having, a reporter molecule, and so forth. The reporter molecule can be a catalyst, such as an enzyme, a polynucleotide coding for a catalyst, promoter, dye, fluorescent molecule, quantum dot, chemiluminescent molecule, coenzyme, enzyme substrate, radioactive group, a small organic molecule, amplifiable polynucleotide sequence, a particle such as latex or carbon particle, metal sol, crystallite, liposome, cell, etc., which may or may not be further labeled with a dye, catalyst or other detectable group, a mass tag that alters the weight of the molecule to which it is conjugated for mass spectrometry purposes, and the like. The label can be selected from electromagnetic or electrochemical materials. In one embodiment, the detectable label is a fluorescent dye. Other labels and labeling schemes will be evident to one skilled in the art based on the disclosure herein.

In another embodiment, the aptamer affinity complex or aptamer covalent complex is detected and/or quantified using Q-PCR. As used herein, "Q-PCR" refers to a PCR reaction performed in such a way and under such controlled conditions that the results of the assay are quantitative, that is, the assay is capable of quantifying the amount or concentration of aptamer present in the test sample. In an exemplary method for the detection and/or quantification of IL-6 that may be present in a test sample, a test sample is contacted with an IL-6 aptamer. An aptamer affinity complex that includes an aptamer bound to IL-6 is allowed to form. If the test sample contains IL-6, an aptamer affinity complex will generally form in the test sample. The aptamer affinity complex is optionally converted, using a method appropriate to the aptamer being employed, to an aptamer covalent complex that includes an aptamer covalently bound to IL-6. As further described herein, following the formation of an aptamer affinity complex and any optional conversion to an aptamer covalent complex, any free aptamer that may be present in the test sample is then partitioned from the aptamer affinity complex or aptamer covalent complex. The aptamer affinity complex or aptamer covalent complex is then quantified using known techniques for the quantitative replication of polynucleotides.

In one embodiment, the amount or concentration of the aptamer affinity complex or aptamer covalent complex in the test sample is determined using TaqMan® PCR. This technique generally relies on the 5'-3' exonuclease activity of the oligonucleotide replicating enzyme to generate a signal from a targeted sequence. A TaqMan probe is selected based upon the sequence of the aptamer to be quantified and generally includes a 5'-end fluor, such as 6-carboxyfluorescein, for example, and a 3'-end quencher, such as, for example, a 6-carboxytetramethylfluorescein, to generate signal as the aptamer sequence is amplified using polymerase chain reaction (PCR). As the polymerase copies the aptamer sequence, the exonuclease activity frees the fluor from the probe, which is annealed downstream from the PCR primers, thereby generating signal. The signal increases as replicative product is produced. The amount of PCR product depends upon both the number of replicative cycles performed as well as the starting concentration of the aptamer.

In another embodiment, the amount or concentration of an aptamer affinity complex or aptamer covalent complex is determined using an intercalating fluorescent dye during the replicative process. The intercalating dye, such as, for example, SYBR® green, generates a large fluorescent signal in the presence of double-stranded DNA as compared to the fluorescent signal generated in the presence of single-stranded DNA. As the double-stranded DNA product is formed during PCR, the signal produced by the dye increases. The magnitude of the signal produced is dependent upon both the number of PCR cycles and the starting concentration of the aptamer.

In another embodiment, the amount or concentration of the aptamer affinity complex or aptamer covalent complex is determined using a "molecular beacon" during the replicative process (see, e.g., Tyagi et al., Nat. Biotech. 16:49 53, 1998; U.S. Pat. No. 5,925,517). A molecular beacon is a specific nucleic acid probe that folds into a hairpin loop and contains a fluor on one end and a quencher on the other end of the hairpin structure such that little or no signal is generated by the fluor when the hairpin is formed. The loop sequence is specific for a target polynucleotide sequence and, upon hybridizing to the aptamer sequence the hairpin unfolds and thereby generates a fluorescent signal.

EXAMPLES

The following examples are provided for illustrative purposes only and are not intended to limit the scope of the invention as defined by the appended claims. All examples described herein were carried out using standard techniques, which are well known and routine to those of skill in the art. Routine molecular biology techniques described in the following examples can be carried out as described in standard laboratory manuals, such as Sambrook et al., Molecular Cloning: A Laboratory Manual, 3rd. ed., Cold Spring Harbor Laboratory Press, Cold Spring Harbor, N.Y., (2001).

Example 1

Aptamer Selection and Sequences

A. Preparation of Candidate Mixtures

Candidate mixtures of partially randomized ssDNA oligonucleotides were prepared by polymerase extension of a DNA primer annealed to a biotinylated ssDNA template as shown in Table 1. The candidate mixtures contained a 40 nucleotide randomized cassette containing dATP, dGTP, dCTP and either BndUTP (5-(N-benzylcarboxyamide-2'-deoxyuridine triphosphate) or NapdUTP (5-(N-naphthylcarboxyamide-2'-deoxyuridine triphosphate).

4 nmol of Template 1 (SEQ ID NO: 1) possessing two biotin residues (designated as B' in the sequence) and 40 randomized positions (designated as N in the sequence) and 4.8 nmol of Primer 1 (SEQ ID NO: 2), which comprises a Cy3 fluorophore, were combined in 100 µL 1×KOD DNA Polymerase Buffer (Novagen), heated to 95° C. for 8 minutes, and cooled on ice. The 100 µL primer:template mixture was added to a 400 µL extension reaction containing 1×KOD DNA Polymerase Buffer, 0.125 U/µL KOD XL DNA Polymerase, and 0.5 mM each dATP, dCTP, dGTP, and either BndUTP or NapdUTP, and incubated at 70° C. for 30 minutes. Double-stranded product was captured via the template strand biotins by adding 1 mL streptavidin-coated magnetic beads (MagnaBind Streptavidin, Pierce, 5 mg/mL in 3 M NaCl containing 0.05% TWEEN-20) and incubating at 25° C. for 10 minutes with mixing. Beads were washed three times with 0.75 mL SB17T Buffer (40 mM HEPES, pH 7.5, 102 mM NaCl, 5 mM KCl, 5 mM MgCl$_2$, 1 mM EDTA, 0.05% TWEEN-20). The aptamer strand was eluted from the beads with 1.2 mL 20 mM NaOH, neutralized with 0.3 mL 80 mM HCl, and buffered with 15 µL 1 M HEPES, pH 7.5. The candidate mixtures were concentrated with a Centricon-30 to approximately 0.2 mL, and quantified by UV absorbance spectroscopy.

TABLE 1

Sequences of Template and Primers

| Oligonucleotide Designation | Sequence (5'→3') | SEQ ID NO: |
|---|---|---|
| Template 1 | AB'AB'TTTTTTTTGGTCTTGTTTC TTCTCTGTG-(N)$_{40}$-CTCGTCACAC ACTCACATC | 1 |
| Primer 1 | Cy3-GATGTGAGTGTGTGACGAG | 2 |
| Primer 2 | ATATATATGATGTGAGTGTGTG ACGAG | 3 |
| Primer 3 | AB'AB'TTTTTTTTGGTCTTG TTTCTTCTCTGTG | 4 |

B' = biotin

B. Preparation of Target Protein

Untagged human IL-6 (R&D Systems) was biotinylated by covalent coupling of NHS-PEO4-biotin (Pierce) to lysines residues. Protein (300 pmol in 50 µL) was exchanged into SB17T with a Sephadex G-25 microspin column. NHS-PEO4-biotin was added to 1.5 mM and the reaction was incubated at 4° C. for 16 hours. Unreacted NHS-PEO4-biotin was removed with a Sephadex G-25 microspin column.

C. Immobilization of Target Protein

Target protein was immobilized on MyOne-SA paramagnetic beads (MyOne SA, Invitrogen, or hereinafter referred to as SA beads) for Round 1 of SELEX. IL-6 was diluted to 0.2 mg/mL in 0.5 mL SB17T and added to 0.5 mL SA beads (pre-washed twice with 20 mM NaOH and once with SB17T). The mixture was rotated for 30 minutes at 25° C. and stored at 4° C. until use.

D. Aptamer Selection with Slow Off-Rate Enrichment Process

Selections were performed with the candidate mixture, comparing binding between samples with target protein (signal S) and samples without target protein (background B). A total of eight rounds of the SELEX process were completed, with selection for affinity and slow off-rate.

For each sample, a 90 µL DNA mixture was prepared in SB17T with 10-20 pmoles candidate mixture (approximately 100 pmoles in the first round). Samples were heated to 95° C. for 3 minutes and cooled to 37° C. at a rate of 0.1 C/second. Samples were combined with 10 µL protein competitor mixture (0.1% HSA, 10 µM casein, and 10 µM prothrombin in SB17T), added to 0.5 mg SA beads and incubated at 37° C. for 5 minutes with mixing. Beads were removed by magnetic separation.

Binding reactions were performed by adding 10 µL target protein (0.5 µM in SB17T) or SB17T to 40 µL DNA mixtures and incubating at 37° C. for 30 min. The slow-off rate enrichment process was employed in different ways. In rounds two through five, samples were diluted 20-fold by adding 950 µL SB17T (preheated to 37° C.), and incubated at 37° C. for 15 minutes prior to capturing complexes. In rounds six and seven, samples were diluted 20-fold by adding 950 µL SB17T (preheated to 37° C.). 50 µL of each diluted sample was diluted again by transferring to 950 µL SB17T (preheated to 37° C.) to give an overall 400-fold dilution, and incubated at 37° C. for 60 minutes prior to capturing complexes. In round eight, samples were diluted 20-fold by adding 950 µL SB17T (preheated to 37° C.). 50 µL of each diluted sample was diluted again by transferring to 950 µL SB17T containing 10 mM dextran sulfate (5 kDa) (preheated to 37° C.) to give an overall 400-fold dilution, and incubated at 37° C. for 60 minutes prior to capturing complexes.

Complexes were captured on SA beads via protein biotins by adding 0.25 mg MyOne-SA beads (Invitrogen) and incubating at 25° C. for 15 minutes with mixing. Free DNA was removed by washing the beads five times with SB17T. Unless indicated, all washes were performed by resuspending the beads in 100 µL wash solution, mixing for 30 seconds at 25° C., separating the beads with a magnet, and removing the wash solution. The aptamer strand was eluted from the beads by adding 85 µL 20 mM NaOH, and incubating at 37° C. for 1 minute with mixing. 80 µL aptamer eluate was transferred to a new tube after magnetic separation, neutralized with 20 µL 80 mM HCl, and buffered with 1 µL 0.5 M Tris-HCl, pH 7.5.

E. Aptamer Amplification and Purification

Selected aptamer DNA was amplified and quantified by QPCR. 48 µL DNA was added to 12 µL QPCR Mix (5×KOD DNA Polymerase Buffer, 25 mM MgCl$_2$, 10 µM forward PCR primer (Primer 2, SEQ ID NO: 3), 10 µM biotinylated reverse PCR primer (Primer 3, SEQ ID NO: 4), 5×SYBR Green I, 0.125 U/µL KOD XL DNA Polymerase, and 1 mM each dATP, dCTP, dGTP, and dTTP) and thermal cycled in a Bio-Rad MyIQ QPCR instrument with the following protocol: 1 cycle of 99.9° C., 15 sec, 55° C., 10 sec, 68° C., 30 min, 30 cycles of 99.9° C., 15 seconds, 72° C., 1 minute. Quantification was done with the instrument software and the number of copies of DNA selected, with and without target protein, was compared to determine signal/background ratios.

Following amplification, the PCR product was captured on SA beads via the biotinylated antisense strand. 1.25 mL SA beads (10 mg/mL) were washed twice with 0.5 mL 20 mM NaOH, once with 0.5 mL SB17T, resuspended in 1.25 mL 3 M NaCl+0.05% Tween, and stored at 4° C. 25 µL SA beads (10 mg/mL in 3 M NaCl) were added to 50 µL double-stranded QPCR products and incubated at 25° C. for 5 minutes with mixing. The beads were washed once with SB17T, and the "sense" strand was eluted from the beads by adding 200 µL 20 mM NaOH, and incubating at 37° C. for 1 minute with mixing. The eluted strand was discarded and the beads were washed 3 times with SB17T and once with 16 mM NaCl.

Aptamer sense strand was prepared with the appropriate modified dUTP (BndUTP or NapdUTP) by primer extension from the immobilized antisense strand. The beads were resuspended in 20 µL primer extension reaction mixture (1× Primer Extension Buffer, 1.5 mM MgCl$_2$, 5 µM forward primer (Primer 1, SEQ ID NO: 2), 0.5 mM each dATP, dCTP, dGTP, and either BndUTP or NapdUTP, and 0.125 U/µL KOD XL DNA Polymerase) and incubated at 68° C. for 30 minutes with mixing. The beads were washed 3 times with SB17T, and the aptamer strand was eluted from the beads by adding 85 µL 20 mM NaOH, and incubating at 37° C. for 1 minute with mixing. 80 µL aptamer eluate was transferred to a new tube after magnetic separation, neutralized with 20 µL 80 mM HCl, and buffered with 5 µL 0.1 M HEPES, pH 7.5.

F. Selection Stringency and Feedback

The relative target protein concentration of the selection step was lowered each round in response to the S/B ratio as follows, where signal S and background B are defined in Section D above:

$$\text{If } S/B < 10, [P]_{(i+1)} = [P]_i$$

$$\text{If } 10 \leq S/B < 100, [P]_{(i+1)} = [P]_i/3.2$$

$$\text{If } S/B \geq 100, [P]_{(i+1)} = [P]_i/10$$

where [P]=protein concentration and i=current round number.

After each selection round, the convergence state of the enriched DNA mixture was determined. 10 µL double-stranded QPCR product was diluted to 200 µL with 4 mM MgCl$_2$ containing 1×SYBR Green I. Samples were overlaid with 75 µL of silicon oil and analyzed for convergence using a C$_0$t analysis which measures the hybridization time for complex mixtures of double stranded oligonucleotides. Samples were thermal cycled with the following protocol: 3 cycles of 98° C., 1 minute, 85° C., 1 minute; 1 cycle of 93° C., 1 minute, 85° C., 15 minutes. During the 15 minutes at 85° C., fluorescent images were measured at 5-second intervals. The fluorescence intensity was plotted as a function of log (time), and an increased rate of hybridization with each SELEX round was observed, indicating sequence convergence.

G. Clone Screening Process & Aptamer Identification

After eight rounds of SELEX, the converged pools were cloned and sequenced. Selected DNA was PCR amplified with non-biotinylated SELEX primers to create AGCT DNA, purified using a QIAquick 96 PCR Purification Kit (Cat#28181), and purified inserts were cloned using Stratagene PCR-Script Cloning Kit (Cat#211189) as per manufacturer's protocol. The ligated SELEX pools were sent to a sequencing vender (Cogenics, Houston, Tex.) for transformation, array into 96-well plates, DNA prep and sequencing. Sequences for ~42 clones were obtained and analyzed for convergence using custom software that determines sequence counts/copy number and identifies common convergence patterns using a local-alignment algorithm. 16 of the ~42 clones were found to bind to streptavidin. Of the remaining clones, sequences with highest representation/copy number in the pool and sequences that were converged to common binding motifs were chosen for further characterization. Two sequences (one Bn-dU and one Nap-dU) were chosen for further analysis and were prepared enzymatically using plasmid DNA obtained from Cogenics as template for PCR amplification.

H. Measurement of Equilibrium Binding Constant ($K_d$)

The equilibrium binding constants of the chosen sequences were measured in an affinity assay. Radiolabeled DNA was heated for 3 minutes at 95° C. in SB17T-0.002 Buffer (40 mM HEPES, pH 7.5, 125 mM NaCl, 5 mM KCl, 5 mM $MgCl_2$, 0.002% TWEEN-20) and slowly cooled to 37° C. Complexes were formed by mixing a low concentration of radiolabeled DNA ($\sim 1\times 10^{-11}$ M) with a range of concentrations of target protein ($1\times 10^{-7}$ M to $1\times 10^{-12}$ M) in SB17T-0.002Buffer, and incubating at 37° C. for 30 minutes. A portion of each reaction was transferred to a nylon membrane and dried to determine total counts in each reaction. Complexes were captured on ZORBAX resin (Agilent), passed through a MultiScreen HV Plate (Millipore) under vacuum, and washed with 200 μL SB17T-0.002 Buffer to separate protein-bound complexes from unbound DNA. The nylon membrane and MultiScreen HV Plate were phosphorimaged and the amount of radioactivity in each sample quantified using a FUJI FLA-3000. The fraction of captured DNA was plotted as a function of protein concentration ($P_t$) and equilibrium binding constants ($K_d$) were determined using $y=(max-min)(P_t)/(K_d+P)+min$. The sequences of the two selected SOMAmers and their binding affinities for IL-6 are listed in Table 2.

TABLE 2

Exemplary Bn-dU and Nap-dU SOMAmers.

| Oligo | Sequence (5'→3') | SEQ ID NO: | $K_d$ (nM) |
|---|---|---|---|
| 2573-20 | GATGTGAGTG TGTGACGAGZ GGGCAGGZZZ GGZAZZAACA CGZZAAGZCG ZGGGGZCGCA CAGAGAAGAA ACAAGACC | 7 | 3 |
| 2574-49 | GATGTGAGTG TGTGACGAGG GGGPPAPGPA GCGAGPGCGP AAGGCGGPGG GCGAGGGAPC ACAGAGAAGA AACAAGACC | 8 | 2 |

Z = Bn-dU; and
P = Nap-dU

Example 2

Cell-Based Antagonist Activity Assays

IL-6 aptamers were screened for inhibition of IL-6 activity in in vitro cell assays.

A. Cell Proliferation Assay

IL-6 induces human erythroleukemic TF-1 cells to proliferate. TF-1 cells were suspended in RPMI1640 medium containing 10% FBS at $1\times 10^4$ cells per well in a 96 well plate and cultured for 1 day at 37° C. in a 5% $CO_2$ incubator. IL-6 (0 or 10 ng/mL) was incubated with or without IL-6 aptamers (2 μM) in water or SB18T Buffer for 30 minutes at 37° C. and applied to the cells in RPMI 1640 medium containing 0.5% FBS. After 5 days at 37° C., Alamar Blue™ was added and cells were incubated an additional 3 hours at 37° C. Fluorescence (excitation at 560 nm, emission at 590 nm) was measured with a luminometer (Wallac 1420 ARVO Light, Perkin Elmer). Results are shown in FIG. 1, where each bar represents the mean±standard deviation of four experiments, normalized to the no-SOMAmer control. Bn-dU 2573-20 (SEQ ID NO: 7) and Nap-dU 2574-49 (SEQ ID NO: 8) both inhibited IL-6 induced proliferation of TF-1 cells to the level of the control without IL-6 induction.

B. Gene Reporter Assay

Figure 2:
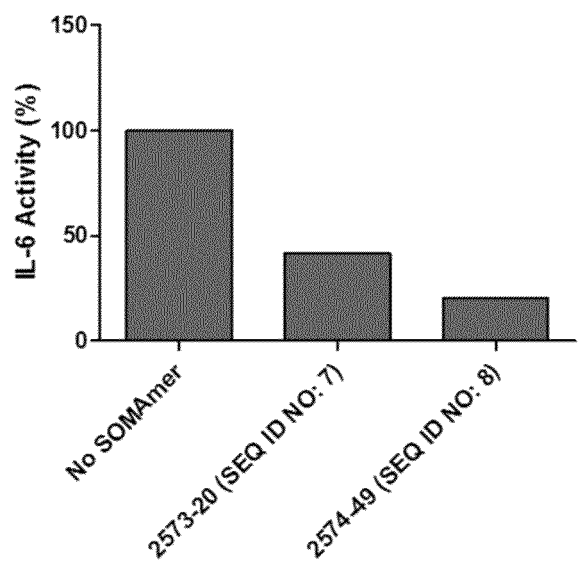
FIG. 2 shows inhibition of STAT-driven luciferase expression by IL-6 aptamers, as described in Example 2.

IL-6 signals through the transcription factor STAT3. L4 cells are HeLa cells transfected with a luciferase gene under STAT control express luciferase upon induction by IL-6, generating a luminescent signal. L4 cells were plated in DMEM containing 10% FBS at $5\times 10^4$ cells per well in a 96-well white plate (Costar, No. 3903) and cultured for 1 day at 37° C. in a $CO_2$ incubator. IL-6 (10 ng/mL) was incubated with or without IL-6 aptamers (10 μM) in water or SB18T for 30 minutes at 37° C. and applied to the cells in phenol-free DMEM containing 0.5% FBS. After 5 hrs at 37° C. in a $CO_2$ incubator, the medium was discarded and luciferase substrate reagent (Perkin Elmer #6016769) was added to the cells for 1 minute at ambient temperature. Luminescence was measured with SpectraMax Plus (Molecular Devices). Results are shown in FIG. 2, where each bar represents the mean of three experiments, normalized to the no-SOMAmer control. These results are consistent with the TF-1 proliferation assay. Bn-dU 2573-20 (SEQ ID NO: 7) and Nap-dU 2574-49 (SEQ ID NO: 8) inhibited IL-6-mediated luciferase expression.

Example 3

Sequence Truncation Studies

IL-6 SOMAmer 2573-20 (SEQ ID NO: 7) is 78 nucleotides in length with Bn-dU modifications and a $K_d=3\times 10^{-9}$ M. Truncations of 2573-20 (SEQ ID NO: 7) were generated to determine if shorter sequences would maintain efficient IL-6 binding. In some instances, shorter aptamers show increased tissue penetration and/or stability against nuclease activity in vivo. Shorter aptamers may also reduce manufacturing costs.

A series of truncated variants of 2573-20 (SEQ ID NO: 7) were synthesized with one or more deletions from the 5' and/or 3' terminus. Sequences of certain truncated aptamers are listed in Table 3. Z represents Bn-dU. The truncated aptamers were tested for affinity to IL-6 in the affinity binding assay as described above.

TABLE 3

Sequences and affinity values ($K_d$) of SOMAmer 2573-20 (SEQ ID NO: 7) and truncated variants.

| Oligo | Sequence (5'→3') | SEQ ID NO: | $K_d$ (nM) |
|---|---|---|---|
| 2573-20_3 | GGCAGGZZZGGZAZZAACACGZZAA GZCGZGGGGZC | 11 | 1.5 |
| 2573-20_5 | GCAGGZZZGGZAZZAACACGZZAAG ZCGZGGGGZC | 12 | >1000 |
| 2573-20_6 | CAGGZZZGGZAZZAACACGZZAAGZ CGZGGGGZC | 13 | >1000 |
| 2573-20_7 | AGGZZZGGZAZZAACACGZZAAGZC GZGGGGZC | 14 | >1000 |
| 2573-20_8 | GGZZZGGZAZZAACACGZZAAGZCG ZGGGGZC | 15 | >1000 |

TABLE 3-continued

Sequences and affinity values ($K_d$) of SOMAmer 2573-20 (SEQ ID NO: 7) and truncated variants.

| Oligo | Sequence (5'→3') | SEQ ID NO: | $K_d$ (nM) |
|---|---|---|---|
| 2573-20_9 | GZZZGGZAZZAACACGZZAAGZCGZGGGGZC | 16 | >1000 |
| 2573-20_10 | ZZZGGZAZZAACACGZZAAGZCGZGGGGZC | 17 | >1000 |
| 2573-20_11 | ZZGGZAZZAACACGZZAAGZCGZGGGGZC | 18 | >1000 |
| 2573-20_12 | GGCAGGZZZGGZAZZAACACGZZAAGZCGZGGGGZ | 19 | 1.4 |
| 2573-20_13 | GGCAGGZZZGGZAZZAACACGZZAAGZCGZGGGG | 20 | 1.9 |
| 2573-20_14 | GGCAGGZZZGGZAZZAACACGZZAAGZCGZGGG | 21 | 2.8 |
| 2573-20_15 | GGCAGGZZZGGZAZZAACACGZZAAGZCGZGG | 22 | 1.0 |
| 2573-20_16 | GGCAGGZZZGGZAZZAACACGZZAAGZCGZG | 23 | >1000 |
| 2573-20_17 | GGCAGGZZZGGZAZZAACACGZZAAGZCGZ | 24 | >1000 |
| 2573-20_18 | GGCAGGZZZGGZAZZAACACGZZAAGZCG | 25 | >1000 |

Variant 2573-20_3 (SEQ ID NO: 11) retained IL-6 binding activity, suggesting that the 5' terminal 21 nucleotides (positions 1-21 of 2573-20 (SEQ ID NO: 7)) are not required for binding IL-6. Similarly, variant 2573-20_15 (SEQ ID NO: 22) retained IL-6 binding activity, suggesting that the 3' terminal 25 nucleotides (positions 54-78 of 2573-20 (SEQ ID NO: 7)) are not required for binding IL-6. Variant 2573-20_15 (SEQ ID NO: 22) was chosen for further characterization.

IL-6 SOMAmer 2574-49 (SEQ ID NO: 8) is 79 nucleotides in length with Nap-dU modifications and a $K_d=2\times10^{-9}$ M. Truncations of 2574-49 (SEQ ID NO: 8) were generated to determine if shorter sequences would maintain efficient IL-6 binding. Sequences of certain truncation variants are shown in Table 4. P represents Nap-dU.

TABLE 4

Sequences and affinity values ($K_d$) of SOMAmer 2574-49 and truncated variants.

| Oligo | Sequence (5'→3') | SEQ ID NO: | $K_d$ (nM) |
|---|---|---|---|
| 2574-49_3 | GGGGPPAPGPAGCGAGPGCGPAAGGCGGPGGGCGAGGGA | 26 | 4.1 |
| 2574-49_6 | GGGGPPAPGPAGCGAGPGCGPAAGGCGGPGGGCGAGGG | 27 | 3.5 |
| 2574-49_7 | GGGGPPAPGPAGCGAGPGCGPAAGGCGGPGGGCGAGG | 28 | 2.6 |
| 2574-49_8 | GGGGPPAPGPAGCGAGPGCGPAAGGCGGPGGGCGAG | 29 | 1.2 |
| 2574-49_9 | GGGGPPAPGPAGCGAGPGCGPAAGGCGGPGGGCGA | 30 | 1.8 |
| 2574-49_10 | GGGGPPAPGPAGCGAGPGCGPAAGGCGGPGGGCG | 31 | 1.9 |
| 2574-49_11 | GGGGPPAPGPAGCGAGPGCGPAAGGCGGPGGGC | 32 | 1.5 |
| 2574-49_12 | GGGGPPAPGPAGCGAGPGCGPAAGGCGGPGGG | 33 | 1.1 |
| 2574-49_13 | GGGGPPAPGPAGCGAGPGCGPAAGGCGGPGG | 34 | 1.1 |
| 2574-49_14 | GGGGPPAPGPAGCGAGPGCGPAAGGCGGPG | 35 | 0.7 |
| 2574-49_15 | GGGPPAPGPAGCGAGPGCGPAAGGCGGPGGGCGAGGGA | 36 | 2.1 |
| 2574-49_16 | GGPPAPGPAGCGAGPGCGPAAGGCGGPGGGCGAGGGA | 37 | 3.9 |
| 2574-49_17 | GPPAPGPAGCGAGPGCGPAAGGCGGPGGGCGAGGGA | 38 | 17 |
| 2574-49_18 | PPAPGPAGCGAGPGCGPAAGGCGGPGGGCGAGGGA | 39 | 19 |
| 2574-49_19 | PAPGPAGCGAGPGCGPAAGGCGGPGGGCGAGGGA | 40 | >1000 |
| 2574-49_20 | APGPAGCGAGPGCGPAAGGCGGPGGGCGAGGGA | 41 | >1000 |

2574-49_14 (SEQ ID NO: 35) retained IL-6 binding activity, suggesting that at least the 3' terminal 30 nucleotides (nucleotides 50 to 79) of 2574-49 (SEQ ID NO: 8) are not required for binding IL-6. 2574-49_18 (SEQ ID NO: 39) retained IL-6 binding activity (although reduced by ~10-fold), suggesting that the 5' terminal 23 nucleotides (nucleotides 1 to 23) of 2574-49 (SEQ ID NO: 8) are not required for binding IL-6. Truncated variant 2574-49_14 (SEQ ID NO: 35) was chosen for further characterization.

Example 4

Deep Sequencing of SELEX Pools

To evaluate more completely the sequences within the 2573-20 and 2574-49 SOMAmer families, the enriched pools were sequenced using 454 pyrosequencing technology. For each pool, the DNA was amplified with 454 primers as described above and the PCR product was purified and normalized using a SequalPrep normalization plate (Invitrogen, Cat# A10510-01). The eluate was run on a gel to confirm the size and purity of each amplicon. The purified PCR product was sequenced at the 454 pyrosequencing facility at the University of Colorado Health Science Center in Aurora CO.

Example 5

Modification of BndU SOMAmer 2573-20_15
(SEQ ID NO: 22)

A. Single Substitutions with Alternative U Modifications

In some instances, U modifications enable IL-6 aptamers to engage in favorable interactions with aromatic amino acids and hydrophobic binding pockets on IL-6. Aptamer 2573-20_15 (SEQ ID NO: 22) was modified at various Bn-dU positions using a library of analogues with different terminal groups and linker lengths. See FIG. 3. In some embodiments, a longer linker may allow additional rotational freedom and better access to hydrophobic regions below the surface of the protein.

Figures 3, 4, 5:
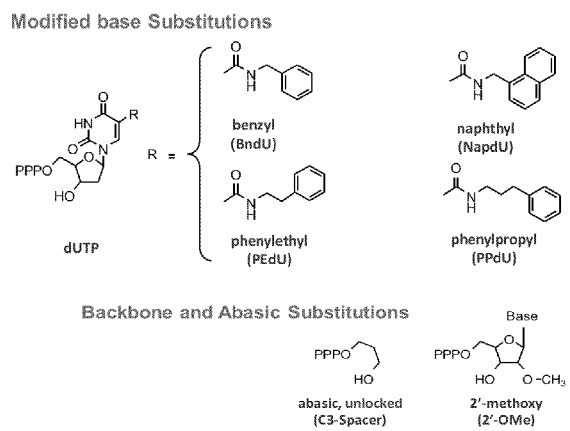
FIG. 3 shows certain dU modifications and backbone modifications, as discussed in Example 5.
FIG. 4 shows relative affinity values of 2573-20_15 (SEQ ID NO: 22) variants with alternative 5-dU modification substitutions, as described in Example 5. Affinity ratios ($K_d$ variant/$K_d$ parent) are shown for each dU position.
FIG. 5 shows relative affinity values of 2573-20_15 (SEQ ID NO: 22) variants with 2'-O-methyl or C3-spacer substitutions, as described in Example 5. Affinity ratios ($K_d$ variant/$K_d$ parent) are shown for each dA, dC, or dG position.

The effect of single substitution of Bn-dU with phenylethyl-dU (PE-dU), phenylpropyl-dU (PP-dU), or naphthylmethyl-dU (Nap-dU) on binding affinity was evaluated. The results are shown in FIG. 4. While no significant improvements in affinity were observed, PE-dU was well-tolerated at all Bn-dU positions except 8 and 14, PP-dU was tolerated at positions 22, 27, and 30, and Nap-dU was tolerated at positions 7, 9, and 12, where a slight improvement in affinity was observed.

B. Single Substitutions with 2'-O-methyl Modifications

DNase I, the predominant nuclease in plasma, can hydrolyze the phosphodiester backbone of DNA in a sequence-independent manner. Backbone modifications at the 2' position of ribose or the non-bridging oxygens provide resistance to nuclease cleavage by DNase I. Significant enhancements in nuclease stability and plasma residence time have been achieved with 2'-F, 2'-O-methyl, and phosphorothioate modifications in RNA aptamers. The tolerance of a 2'-O-methyl substitution at each dA, dG, and dC position of 2573-20_15 (SEQ ID NO: 22) was evaluated.

The results of that experiment are shown in FIG. 5. A 2'-O-methyl modification was well tolerated at positions dC3, dG6, dA16-dC20, and dC28, even causing an improvement in affinity at positions dC3, dG6 and dC28.

C. Single Substitutions with C3-spacer Modifications

A C3-spacer substitution, comprised of a three carbon linker designed to span the same distance as a nucleotide, but lacking the ribose sugar or base, provides DNase I resistance, and can also be used to probe nucleotide base interactions at each position, much like an alanine scan for proteins. The tolerance of a C3-spacer substitution at each dA, dG, and dC position of 2573-20_15 (SEQ ID NO: 22) was evaluated.

The results of that experiment are shown in FIG. 5. The C3-spacer modification was tolerated at positions dC18-dG21 and dC28. This same region was relatively unaffected by the 2'-O-methyl modification, suggesting that this region may not be involved in significant protein contacts.

D. Multiple Substitutions of Tolerated Modifications

Figure 6:
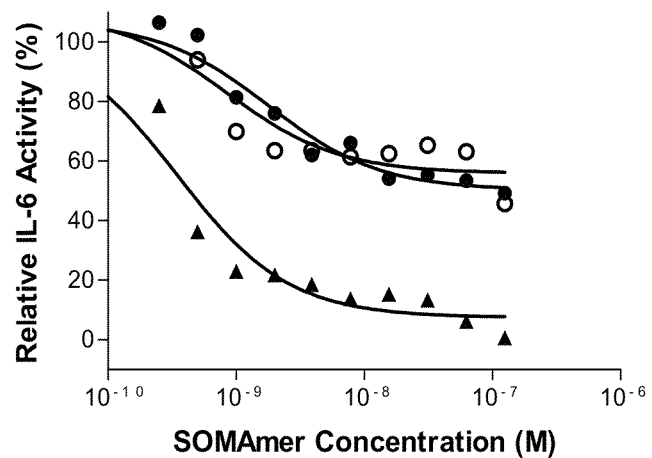
FIG. 6 shows inhibition activity of variants of 2573-20 (SEQ ID NO: 7), as described in Example 5 (●2573-20_15 (SEQ ID NO: 22); ○ 2573-20_135 (SEQ ID NO: 100); ▲2573-20_136 (SEQ ID NO: 101)).

Based on the binding and inhibition activities of certain variants with 2'-O-methyl and C3-spacer substitutions, a series of variants was made by combining tolerated 2'O-methyl and C3-spacer substitutions. These sequences were tested for binding and inhibition activity in the gene reporter assay. The combination of six 2'-O-methyl substitutions at positions dC3, dG6, dA16, dA19, dC20 and dC28 in variant 2573-20_135 (SEQ ID NO: 100) improved the binding affinity by 5-fold. Additional 2'-O-methyl or C3-spacer substitutions resulted in a loss of binding activity in this experiment. It was also found that substitution of Bn-dU9 with PE-dU and Bn-dU12 with Nap-dU in variant 2573-20_136 (SEQ ID NO: 101) resulted in improved inhibition activity, increasing maximal inhibition of IL-6 in the Gene Reporter assay to nearly 100% with an $IC_{50}$ value of $5\times10^{-10}$ M. See FIG. 6 (●2573-20_15 (SEQ ID NO: 22); ○ 2573-20_135 (SEQ ID NO: 100); ▲ 2573-20_136(SEQ ID NO: 101)). A comparison of variants 2573-20_135 (SEQ ID NO: 100) and 2573-20_136 (SEQ ID NO: 101), which are identical except for a Nap-dU at position 12 of 2573-136 (Bn-dU in 2573-20_135 (SEQ ID NO: 100)), shows that the NapdU substitution at position 12 results in improved maximal inhibition.

Example 6

Modification of NapdU SOMAmer 2574-49_14
(SEQ ID NO: 35)

Figure 7:
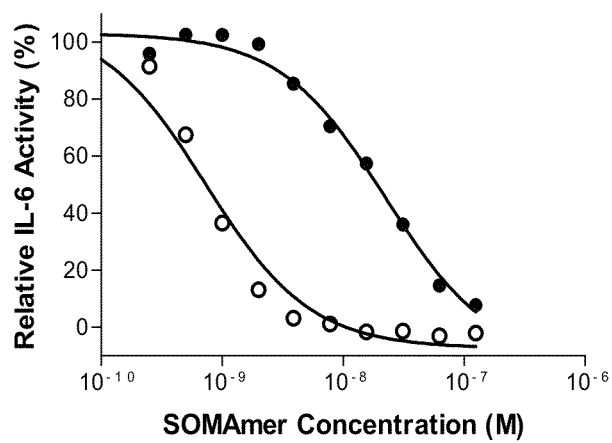
FIG. 7 shows inhibition activity of variants of 2574-49 (SEQ ID NO: 8), as described in Example 6 (●2574-49_3 (SEQ ID NO: 26); ○ 2574-49_260 (SEQ ID NO: 400)).

The truncated NapdU SOMAmer 2574-49_14 (SEQ ID NO: 35) was modified using the strategies described in Example 5. Aptamer 2574-49_260 (SEQ ID NO: 400) is a variant of 2574-49_14 (SEQ ID NO: 35) with three C3-spacer modifications (positions 1, 14 and 15) and inhibits IL-6 with approximately 30-fold higher potency than 2574-49_3 (SEQ ID NO: 26). See FIG. 7 (● 2574-49_3 (SEQ ID NO: 26); ○ 2574-49_260 (SEQ ID NO: 400)). The composition of 2574-49_260 (SEQ ID NO: 400) is shown in Table 12, below.

Example 7

Assessment of Aptamer Stability in Serum

The effect of post-SELEX aptamer truncations and modifications on sensitivity to serum nucleases was evaluated by exposing aptamers to fresh serum and quantifying the extent of aptamer hydrolysis as a function of time by polyacrylamide gel electrophoresis (PAGE). A variant of Bn-dU SOMAmer 2573-20 15 (SEQ ID NO: 22) with all Bn-dU residues replaced with dT (2573-20_116 (SEQ ID NO: 300)), and a variant of Nap-dU SOMAmer 2574-49_14 (SEQ ID NO: 35) with all Nap-dU residues replaced with dT (2574-49_456 (SEQ ID NO: 572)) were included in this study as controls to determine the effect of the modified dU positions on nuclease stability. All aptamers tested in this assay contained a 3' inverted dT to protect the aptamer from 3' to 5' exonuclease activity.

Each aptamer was diluted to 0.5 µM in SB17T and incubated with 90% serum at 37° C. Aliquots were drawn at various time points from 0-48 hours, extracted once with phenol and once with chloroform, and concentrated with a YM-10 molecular weight cut-off filter. Samples were analyzed by denaturing PAGE using a 10% polyacrylamide/urea gel and the aptamer was stained with SYBR gold. Stained DNA was imaged with a FUJI Fluorescent Image Analyzer FLA-3000 and quantified using the ImageGauge software package to determine the fraction of intact aptamer at each time point.

Exposure to 90% human serum for 48 hours at 37° C. had little effect on SOMAmer 2573-20_136 (SEQ ID NO: 101) (>95% intact), while the control dT variant 2573-20_116 (SEQ ID NO: 300) was almost completely degraded (<5% intact), and SOMAmer 2573-20_15 (SEQ ID NO: 22) was partially degraded (50% intact). See FIG. 8A (2573-20_136 (SEQ ID NO: 101) (●), 2573-20_15 (SEQ ID NO: 22) (○), 2573-20_116 (SEQ ID NO: 300) (▲)). Likewise, Nap-dU SOMAmer 2574-49_260 (SEQ ID NO: 400) was largely unaffected by this treatment (>95% intact), while control dT variant 2574-49_456 (SEQ ID NO: 572) (<5% intact) was significantly hydrolyzed. Nap-dU variant 2574-49_14 (SEQ ID NO: 35) (60% intact) was also somewhat hydrolyzed. See FIG. 8B (2574-49_260 (SEQ ID NO: 400) (●), 2574-49_14 (SEQ ID NO: 35) (○), 2574-49_456 (SEQ ID NO: 572) (▲)). These results indicate dU modifications can provide a significant level of protection against endonuclease cleavage, and additional backbone 2'-O-methyl modifications further stabilize these SOMAmers. Similar results were observed in rat and cynomolgus monkey serum. See FIG. 8C.

Example 8

2573-20_136 (SEQ ID NO: 101) and 2574-49_260 (SEQ ID NO: 400) Compete for Binding to IL-6

Figure 9:
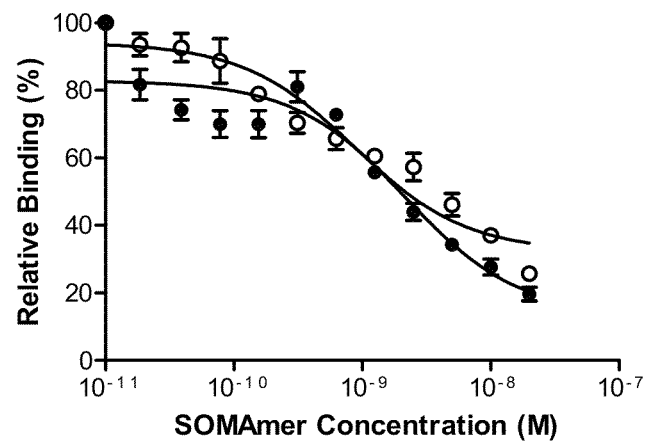
FIG. 9 shows a competition assay between aptamers 2573-20_136 (SEQ ID NO: 101) and 2574-49_260 (SEQ ID NO: 400), as described in Example 8 (●2573-20_136 (SEQ ID NO: 101); ○ 2574-49_260 (SEQ ID NO: 400)).

To determine whether SOMAmers 2573-20_136 (SEQ ID NO: 101) and 2574-49_260 (SEQ ID NO: 400), which were obtained in separate SELEX experiments, bind to overlapping sites on IL-6, a binding competition experiment was performed. IL-6 protein was coupled to the surface of a microtiter plate (Nunc Maxisorp) by passive adsorption. Biotinylated SOMAmer 2573-20_136 (SEQ ID NO: 101) (100 µM) was mixed with different concentrations of competitor (non-biotinylated SOMAmer 2573-20-136 (SEQ ID NO: 101) or 2574-49_260 (SEQ ID NO: 400), 0.02-20 nM) in SB18T Buffer (40 mM HEPES, pH 7.5, 102 mM NaCl, 5 mM KCl, 5 mM $MgCl_2$, 0.05% TWEEN-20) and added to the plate. After incubating for 60 minutes at 25° C. with shaking at 500 RPM, unbound SOMAmer was removed by washing and the plate was incubated with streptavidin coupled to horseradish peroxidase (1 µg/mL). The amount of remaining biotinylated 2573-20_136 (SEQ ID NO: 101) was measured with horseradish peroxidase substrate (TMB; 3,3',5,5'-tetramethylbenzidine) according to standard procedures. The percent of biotinylated 2573-20_136 (SEQ ID NO: 101) bound to IL-6 (relative to the no-competitor control) was plotted as a function of competitor SOMAmer concentration. See FIG. 9 (● 2573-20_136 (SEQ ID NO: 101); ○ 2574-49_260 (SEQ ID NO: 400)). As 2574-49_260 (SEQ ID NO: 400) concentration increases, the amount of 2573-20_136 (SEQ ID NO: 101)bound decreases, indicating the two SOMAmers compete for binding to a common site or overlapping sites on IL-6.

Example 9

Aptamer 2573-20_136 (SEQ ID NO: 101) Blocks Binding of IL-6 to IL-6 Receptor

Figure 10:
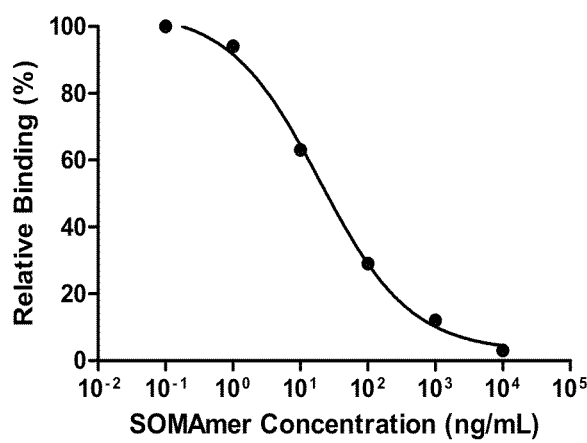
FIG. 10 shows inhibition of IL-6 binding to soluble receptor sIL-6R by aptamer 2573-20_136 (SEQ ID NO: 101), as described in Example 9.

The effect of SOMAmer 2573-20_136 (SEQ ID NO: 101) on binding of IL-6 to soluble IL-6 receptor (sIL-6R) was determined in a sandwich assay format. sIL-6R (100 ng) was coupled to the surface of a microtiter plate by passive adsorption. Biotinylated IL-6 (50 ng/mL) was mixed with different concentrations of 2573-20_136 (SEQ ID NO: 101) (0-10 µg) in PBST Buffer (PBS with 0.05% TWEEN-20) and added to the plate. After incubating for 120 minutes at 25° C. with shaking at 200 RPM, unbound IL-6 was removed by washing and the amount of remaining biotinylated IL-6 was measured with streptavidin horseradish peroxidase according to standard procedures. The percent of biotinylated IL-6 bound to sIL-6R (relative to the no-competitor control) was plotted as a function of SOMAmer concentration. See FIG. 10. As 2573-20_136 (SEQ ID NO: 101) concentration increases, the amount of bound sIL-6R decreases, indicating the SOMAmer blocks the binding of IL-6 to its receptor sIL-6R.

Example 10

Aptamer 2573-20_136 (SEQ ID NO: 101) Inhibits Monkey But Not Rat IL-6

Ortholog cross-reactivity of 2573-20_136 (SEQ ID NO: 101) was evaluated by comparing the binding and inhibition properties against cynomolgus monkey and rat IL-6. The amino acid identity between human and cynomolgus monkey IL-6 is 96%, while human and rat IL-6 are only 39.9% identical. Monkey IL-6 was prepared with a 6-His tag by expression in CHO cells and purified using an NTA column according to standard protocols. The concentration of IL-6 protein was determined by ELISA. Rat IL-6 was purchased (R&D Systems).

2573-20_136 (SEQ ID NO: 101) binds to monkey IL-6 with $K_d=2\times10^{-9}$ M, and rat IL-6 with $K_d=6\times10^{-7}$ M. Furthermore, 2573-20_136 (SEQ ID NO: 101) inhibits monkey IL-6 activity in the Gene Reporter Assay with $IC_{50}=9.7\times10^{-9}$ M.

Example 11

Comparison of Aptamer and Antibody Inhibition Potency

The potency of IL-6 inhibition of PEG-N-2573-20_136 (2573-20_136 (SEQ ID NO: 101) with a 40 kDa PEG conjugated to the 5' terminus) and anti-IL-6R antibody Tocilizumab was compared in the Cell Proliferation Assay. U266B1 cells were suspended with PEG-N-2573-20_136 or Tocilizumab (0, 1, 10 or 100 µg/mL) in RPMI 1640 medium containing 10% FBS at $1\times10^4$ cells per well in a 96 well plate and cultured for 30 minutes at 37° C. in a 5% $CO_2$ incubator. IL-6 (100 ng/mL) was applied to the cells for 2 days at 37° C. Alamar Blue™ was added and cells were incubated an additional 3 hours at 37° C. Fluorescence (excitation 560 nm, emission 590 nm) was measured with a luminometer (Wallac 1420 ARVO Light, Perkin Elmer). Results are shown in Table 5. Values represent the mean±standard error of 3 experiments (3 wells per one experiment) at each concentration. Statistically significant differences were observed between the no-inhibitor control group (0.0±15.7%, n=3) and PEG-N-2573-20_136 or Tocilizumab (Dunnett's test, two-tailed, *p<0.05, **p<0.01). PEG-N-2573-20_136 achieved complete inhibition of IL-6 at 1 µg/mL (8.3×10$^{-8}$ M), while Tocilizumab achieved 60% inhibition at a roughly equivalent molar concentration (6.7×10$^{-8}$ M).

TABLE 5

Inhibition of IL-6-dependent cell proliferation by PEG-N-2573-20_136 (2573-20_136 (SEQ ID NO: 101) with a 40 kDa PEG conjugated to the 5' terminus) and Tocilizumab.

| Inhibitor | Concentration (µg/mL) | Concentration (M) | Relative IL-6 Inhibition (%) |
|---|---|---|---|
| PEG-N-2573-20_136 | 1 | 8.3 × 10$^{-8}$ | 101.2 ± 3.8** |
|  | 10 | 8.3 × 10$^{-7}$ | 121.2 ± 6.2** |
|  | 100 | 8.3 × 10$^{-6}$ | 126.9 ± 4.9** |
| Tocilizumab | 1 | 6.7 × 10$^{-9}$ | 15.1 ± 8.0 |
|  | 10 | 6.7 × 10$^{-8}$ | 60.7 ± 21.6* |
|  | 100 | 6.7 × 10$^{-7}$ | 57.0 ± 4.7 |

Example 12

Antagonist Activity of 2573-20_136 (SEQ ID NO: 101) Against IL-6 Responsive Tumor Cells IL-6 receptor is over-expressed on many cancers including brain, prostate, and kidney, and elevated IL-6 ligand and receptor expression are associated with poor patient survival Inhibition of IL-6 signaling may suppress growth, survival, and/or metastatic potential of tumor cells. Inhibition of tumor cell proliferation by PEG-N-2573-20_136 (2573-20_136 (SEQ ID NO: 101) with a 40 kDa polyethylene glycol conjugated to its 5' terminus) was measured for PC3 prostatic carcinoma, HepG2 hepatoma, and U87 MG glioma cells. Cells were plated in F12K medium containing 10% FBS (PC3 cells) or DMEM medium containing 10% FBS (HepG2 and U87 MG cells) at 1×10$^{4}$ cells per well in a 96 well plate and cultured for 1 day at 37° C. in a 5% CO$_2$ incubator. PEG-N-2573-20_136 (SEQ ID NO: 101) (10 µg/mL) was applied in each medium for 7 days at 37° C. Alamar Blue™ was added and cells were incubated an additional 1-3 hours at 37° C. Fluorescence (excitation 560 nm, emission 590 nm) was measured with a luminometer (Wallac 1420 ARVO Light, Perkin Elmer). Results are shown in Table 6. Values represent the mean±standard error of 3 experiments (2 wells per one experiment). PEG-N-2573-20_136 suppressed proliferation of all three cell types.

TABLE 6

PEG-N-2573-20_136 (2573-20_136 (SEQ ID NO: 101) with a 40 kDa polyethylene glycol conjugated to its 5' terminus) inhibition of tumor cell proliferation.

| Cell Type | Abbreviation | Relative Proliferation (%) |
|---|---|---|
| Prostatic carcinoma | PC3 | 74.4 ± 1.0 |
| Hepatoma | HepG2 | 85.0 ± 6.6 |
| Glioma | U87MG | 87.3 ± 4.9 |

Under the same experimental conditions, 12 aptamers (10 or 100 µg/mL) or anti-IL-6 receptor antibody Tocilizumab (150 or 1500 µg/mL) inhibited tumor cell proliferation. Results are shown in Table 7. Values represent the mean±standard error of 3 experiments (3 wells per one experiment) for each aptamer or Tocilizumab. Statistically significant differences were observed between control (U87 MG: 100.0±3.7%, HepG2: 100.0±6.7%, respectively) and aptamers or Tocilizumab (Dunnett's test, two-tailed, *p<0.05, **p<0.01).

TABLE 7

Aptamer inhibition of tumor cell proliferation.

| Inhibitor | SEQ ID NO | Concentration (µg/mL) | Relative Proliferation (%) U87MG | HepG2 |
|---|---|---|---|---|
| None | N/A | 0 | 100.0 ± 3.7 | 100.0 ± 6.7 |
| Tocilizumab | N/A | 150 | 99.0 ± 3.2 | 88.5 ± 2.8 |
|  |  | 1500 | 77.5 ± 4.6* | 79.8 ± 3.9 |
| PEG-N-2573-20_136 | 101 | 10 | 87.3 ± 4.9 | 85.0 ± 6.6 |
|  |  | 100 | 70.6 ± 1.9** | 69.1 ± 0.4* |
| PEG-N-2573-20_745 | 218 | 100 | 62.6 ± 3.4** | 68.5 ± 0.4* |
| PEG-N-2573-20_746 | 219 | 100 | 68.2 ± 1.0** | 79.8 ± 2.9* |
| PEG-N-2573-20_772 | 221 | 100 | 85.7 ± 3.3* | 89.0 ± 8.0 |
| PEG-N-2573-20_773 | 222 | 100 | 67.8 ± 1.2** | 72.1 ± 1.6* |
| PEG-N-2573-20_780 | 224 | 100 | 67.1 ± 3.2** | 75.6 ± 2.1* |
| PEG-N-2573-20_834 | 232 | 100 | 84.9 ± 4.6 | 88.8 ± 8.6 |
| PEG-N-2573-20_835 | 233 | 100 | 80.5 ± 3.0* | 79.9 ± 3.4* |
| PEG-N-2573-20_836 | 234 | 100 | 67.6 ± 2.5** | 77.6 ± 2.8* |
| PEG-N-2573-20_837 | 235 | 100 | 71.4 ± 2.5** | 84.6 ± 2.8 |
| PEG-N-2573-20_838 | 236 | 100 | 76.2 ± 2.0** | 84.2 ± 6.1 |
| PEG-N-2574-49_260 | 400 | 100 | 76.3 ± 3.8* | 72.4 ± 1.6* |

Example 13

Crystal Structure of Aptamer 2573-20_136 (SEQ ID NO: 101) Bound to IL-6

Full-length IL-6 (SEQ ID NO: 9) is comprised of 212 amino acids with an N-terminal signal peptide of 29 amino acids and a four helix bundle arranged in an up-up-down-down topology (Somers et al., EMBO J. 1997: 989-997). The helices are historically designated A through D, from N-terminus to C-terminus, and contain 20-25 residues per helix with long loops connecting the helices. The N-terminal 20 residues do not adopt any secondary structure and only the last 7 residues of this flexible loop are discerned in the crystal structure. There is also a fifth short helix of 11 residues (amino acids 141-152) present in the long loop between helices C and D, a common feature in the long-chain family of four helix bundle proteins (Mott, H. R. and Campbell, I. D., Current Opinion in Str. Bio., 1995. 5:114-121). Following this short helix the remaining residues of the C-D loop (amino acids 131-140) are disordered and not visible in the crystal structure. Likewise, the long A-B loop (amino acids 43-79), contains 17 missing residues (amino acids 44-60). The form used in our crystallization studies comprises amino acid residues 30-212 based on full-length human IL-6.

For crystallization studies, we used SOMAmer 2573-20_136 (SEQ ID NO: 101), shown below:

(SEQ ID NO: 101)
5'-$G_1G_2C_3A_4G_5G_6Z_7Z_8E_9G_{10}G_{11}P_{12}A_{13}Z_{14}Z_{15}A_{16}A_{17}C_{18}A_{19}C_{20}G_{21}Z_{22}Z_{23}A_{24}A_{25}G_{26}Z_{27}C_{28}G_{29}Z_{30}G_{31}G_{32}$-3';

wherein Z is Bn-dU, E is PE-dU, P is Nap-dU, and nucleotides 3, 6, 16, 19, 20, and 28 comprise 2'-OMe modifications. See also Table 10.

Figure 11:
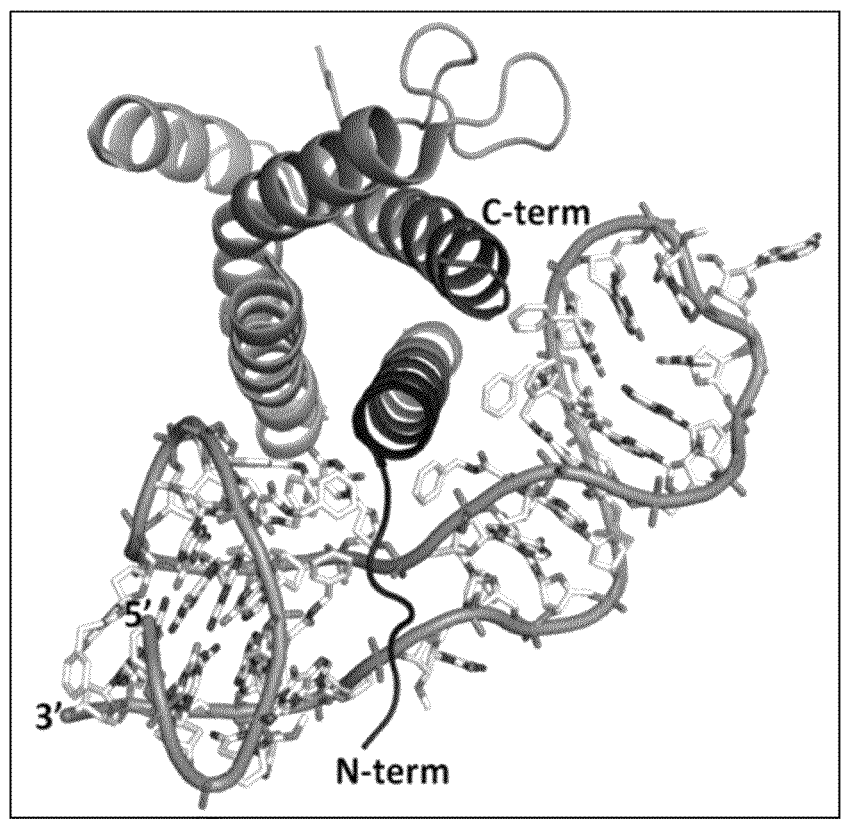
FIG. 11 shows 2.55 Å crystal structure of SOMAmer 2573-20_136 (SEQ ID NO: 101) bound to human IL-6 (form 2 chains A & B), as described in Example 13.
Figure 12:
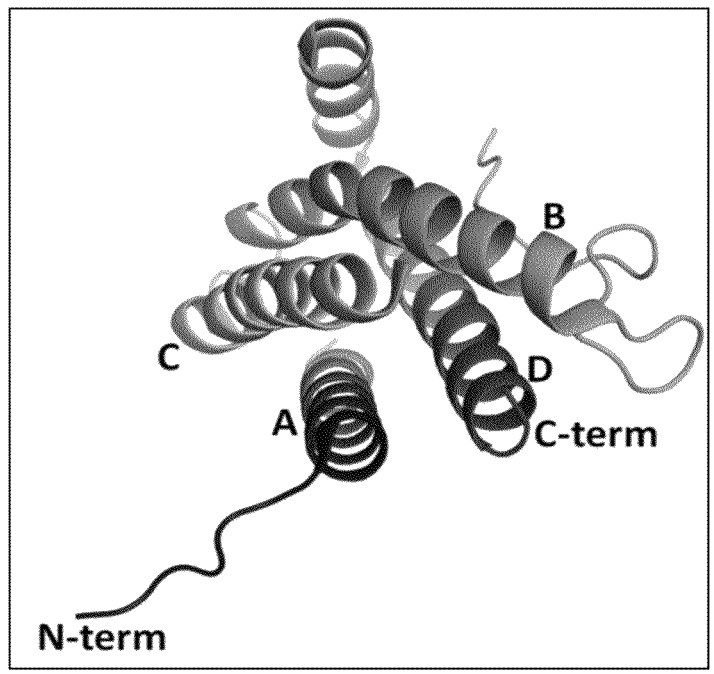
FIG. 12 shows superposed structures of the human IL-6 protein in a complex with the SOMAmer or with IL-6/IL-6Rα/gp130 structure (Boulanger, M. J., et al., Science. 2003. 300: 2101-2104), as described in Example 13. The helices are labeled (A-D) from N— to C-terminus and are colored blue (dark and light for SOMAmer and receptor complex; helix A), green (helix B), yellow (helix C) and red (helix D). Color scheme is maintained throughout the figures.

We obtained two crystal structures (referred to as form 1 and form 2) of the human IL-6 protein (numbering based on mature form) bound to SOMAmer 2573-20_136 (SEQ ID NO: 101). Form 1 was solved to 2.40 Å and contained one IL-6 molecule and one SOMAmer molecule per asymmetric unit. Form 2 was solved to 2.55 Å and contained two molecules of IL-6 (chains A and C) and two molecules of SOMAmer (chains B and D) per asymmetric unit. The two structures are very similar overall and could be assigned to space group P32. Form 1 complex can be superposed with both complexes from form 2 with a root-mean-square deviation (RMSD) of 0.431 Å spanning chains A (IL-6) and B (SOMAmer) over 898 atoms and chains C (IL-6) and D (SOMAmer) with an RMSD of 0.456 Å over 945 atoms. Similarly, the two SOMAmer molecules in form 2 align well, with an RMSD of 0.537 Å over 655 atoms. Both form 1 and form 2 structures lack the first 13-15 residues of the unstructured N-terminus of IL-6 as well as residues in loop regions connecting the helices and at the C-terminus (amino acids 130-135 in form 1 and amino acids 135-140 in form 2). Additionally, nucleotides 19 and 20 of the SOMAmer are missing in form 1, but can be resolved in form 2. Since the form 1 and form 2 structures are nearly identical, the majority of the analysis reported here was done using the complete IL-6:SOMAmer structure in form 2, specifically chains A and B. The IL-6:SOMAmer complex comprised of chains A (IL-6) and B (SOMAmer) is shown in FIG. 11. The SOMAmer interacts with the N- and C-terminal poles of the IL-6 four helix bundle, wrapping around the protein perpendicular to the long axis of the helices. The conformation of IL-6 in the SOMAmer bound structure is essentially the same as that observed in the IL-6/IL-6Rα/gp130 hexameric structure, PDB ID 1P9 M (Boulanger, M. J., et al., Science. 2003. 300: 2101-2104). These two IL-6 structures can be superposed with an RMSD of 0.717 Å over 832 atoms. See FIG. 12.

With regards to conformational preferences within the SOMAmer, all bases are in the anti nucleoside conformation except, 2'-O-Methyl C28, G1, G5, G10 and G31, which are in the syn conformation. Most of the riboses are in the C2'-endo conformation (18/32), with the remainder in C1'-exo (6/32), C3'-exo (3/32), C3'-endo (2/32), O4'-endo (2/32) and C4'-exo (1/32) conformations. See Table 8, below. All of the modified bases are in the trans conformation with the exception of Bn-dU22 which is in the cis conformation.

TABLE 8

| SOMAmer ribose conformations | |
| --- | --- |
| Pucker | Residue |
| C2'-endo | G1 |
| C1'-exo | G2 |
| C3'-endo | C3 |
| C2'-endo | A4 |
| C3'-exo | G5 |
| C2'-endo | G6 |
| C3'-exo | Z7 |

TABLE 8-continued

| SOMAmer ribose conformations | |
| --- | --- |
| Pucker | Residue |
| C2'-endo | Z8 |
| C2'-endo | E9 |
| C2'-endo | G10 |
| C2'-endo | G11 |
| C2'-endo | P12 |
| C1'-exo | A13 |
| O4'-endo | Z14 |
| C1'-exo | Z15 |
| C2'-endo | A16 |
| C2'-endo | A17 |
| C3'-endo | C18 |
| C3'-exo | A19 |
| C2'-endo | C20 |
| C2'-endo | G21 |
| O4'-endo | Z22 |
| C4'-exo | Z73 |
| C2'-endo | A24 |
| C2'-endo | A25 |
| C2'-endo | G26 |
| C1'-exo | Z27 |
| C2'-endo | C28 |
| C2'-endo | G29 |
| C1'-exo | Z30 |
| C2'-endo | G31 |
| C1'-exo | G32 |

Figure 13:
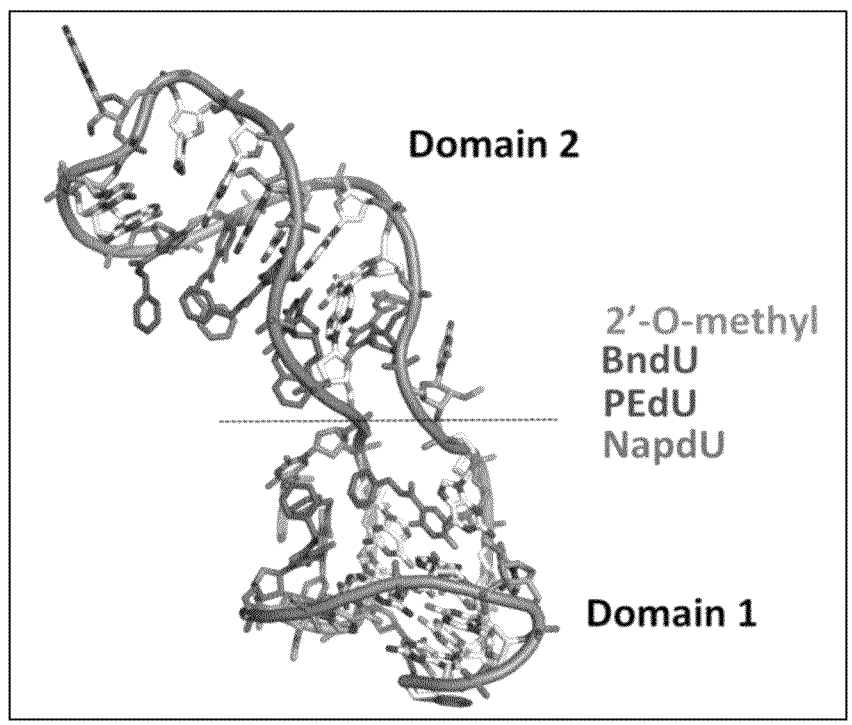
FIG. 13 shows the structure of the SOMAmer can be divided into two domains, as described in Example 13. Domain 1 contains a G-quartet motif and domain 2 has a stem-loop configuration. Modified nucleotides are labeled by color: Bn-dU (magenta), PE-dU (red) and Nap-dU (green). Positions with 2'-O-methyl substitutions are indicated in cyan. The same color scheme is maintained throughout the figures.

The SOMAmer can be divided into two structurally distinct domains that are essentially split at the N-terminal α-helix of IL-6 (helix A), with each SOMAmer domain interacting with helix A and one other helix of IL-6. See FIG. 11. Domain 1 comprises nucleotides 1-12 and 29-32 and contains a G-quartet motif composed of two G-tetrads as well as both the 5' and 3' termini. Domain 2 adopts a stem-loop motif composed of nucleotides 13-28. See FIG. 13.

Domain 1: G-quartet

There are no Watson-Crick base pairs in domain 1, where the bulk of the structural integrity is derived from the G-quartet. Each G-tetrad is coordinated by a sodium ion which sits in the plane of the tetrad. Tetrad one contains G1, G6, G10 and G32 while tetrad two contains G2, G5, G11 and G31. See FIG. 14A. Each G-quartet contains two bases in the syn conformation and two in the anti conformation. This allows each guanosine base to make two hydrogen bonds with a neighboring guanosine on the Watson-Crick face as well as on the Hoogsteen face. The sodium ions are then coordinated by the carbonyl oxygen on C6.

G-quartets are classified by the orientation of the strands and the glycosidic conformation. The strands in the SOMAmer G-quartet run up-down-up-down creating an anti-parallel G-tetrad core with three lateral or edgewise loops. See FIG. 14B. Of the 26 possible topologies for three loops with contiguous G-quadruplex strands, only six have been experimentally determined. This specific topology was previously seen in the thrombin-binding DNA aptamer (Macaya, R. F., et al., PNAS. 1993. 90(8):3745-3749).

There are five modified bases in the G-quartet domain, four of which form a hydrophobic surface that contacts the protein. This hydrophobic pocket is created as a discontiguous cluster of side chains from Bn-dU7, Bn-dU8, Nap-dU12 and Bn-dU30 residues (designated Bn7, Bn8, Nap12 and Bn30) that are brought in proximity of each other by the overall scaffold of the G-quartet in a manner that creates a series of π-stacking interactions See FIG. 14C. Bn-dU8 uridine ring forms a π-stacking interaction with Nap12 while Bn8 is sandwiched between the uridine rings of Nap-dU12 and Bn-dU7 creating an additional π-stacking interaction. Bn8 is also surrounded with Bn7, Nap12 and Bn30 with which it forms edge-to-face π-stacking interactions. In a sense, the Bn-dU8 nucleotide appears to serve as a core of the hydrophobic cluster that simultaneously engages three other modified nucleotide side chains as well as two bases. G29, which borders domain 2, stacks with the base of Bn-dU30, which in turn stacks with G11 of the G-quartet. The remaining modified nucleotide in this domain, PE-dU9, does not interact with the protein, but rather tucks under the G-quartet, with the uridine ring stacking with G32 and the modified side chain PE9 extruded into the solvent. See FIG. 14D. Overall, the B-factors for domain 1 are much lower than those for domain 2, most likely because the G-quartet provides rigidity to this half of the SOMAmer structure (data not shown).

IL-6:SOMAmer Interactions in Domain 1

Figure 15:
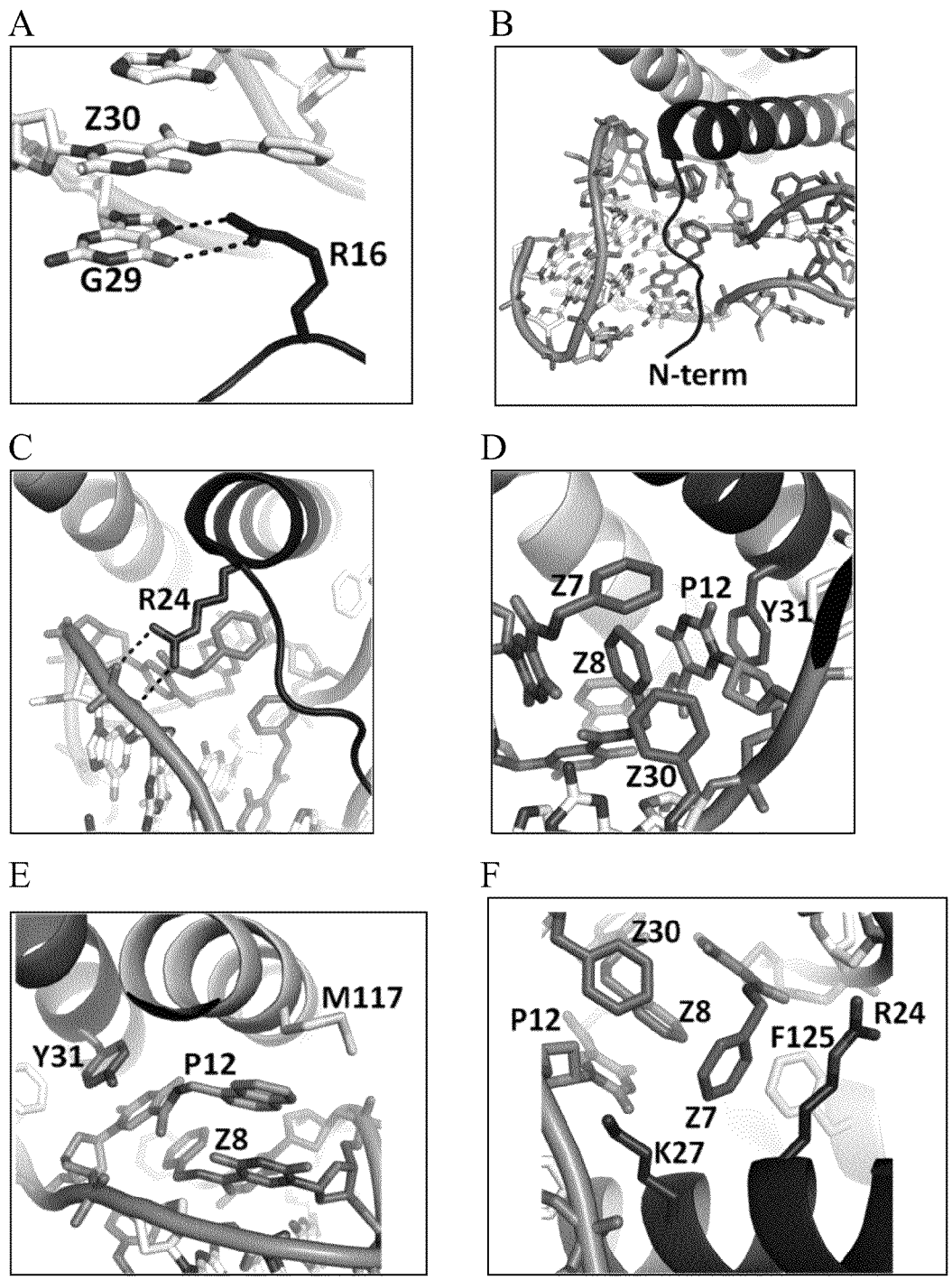
FIG. 15 shows protein-SOMAmer interactions in domain 1, as described in Example 13. (A) Residue R16 on the IL-6 N-terminal tail hydrogen bonds on the Hoogsteen face of G29. The benzyl group of Bn-dU30 stacks against the methylene side chain of R16. (B) The N-terminal tail of IL-6 is sandwiched between the backbone of the SOMAmer, protecting the hydrophobic modified nucleotides from solvent. (C) R24 on helix A of IL-6 forms a salt bridge to the SOMAmer backbone at G5-G6, further sealing the hydrophobic pocket from solvent. (D) Y31 on helix A of IL-6 stacks with Nap 12 which in turn stacks with Bn8 and the uridine ring of Bn-dU7. Bn7 and Bn30 have edge-to-face interactions with the stacked residues. (E) Nap12 has hydrophobic interactions with the methylene side chain of M117 on helix C of IL-6. The naphthyl group also stacks against the uridine ring of Bn-dU8. (F) Bn7 and Bn8 have edge-to-face interactions with F 125 on helix C and Bn7 interacts with the methylene side chains of R24 and K27.

Seven residues on the IL-6 protein have intermolecular contacts with domain 1 of the SOMAmer. In the N-terminal tail, R16 hydrogen bonds to G29 on the Hoogsteen face. See FIG. 15A. Additionally, R16 has hydrophobic contacts with Bn30 which stacks against the arginine methylene side chain. Hydrophobic intermolecular forces play a significant role in the protein-DNA interactions, as seen in this repeated theme of modified nucleotides interacting with methylene side chains of surface amino acids. The N-terminal tail of the IL-6 protein lies in a pocket, created by the unusual curvature of the DNA, where it is sandwiched between the DNA backbone and shelters the hydrophobic cluster of Bn7, Bn8, Nap12 and Bn30 from solvent. See FIG. 15B. The atypical curvature of the SOMAmer backbone is distorted such that the phosphate groups are in close proximity to each other and directed toward the solvent with the modified bases pointed away from the solvent, clustering together forming a protein-like hydrophobic core. A salt bridge between R24 at the N-terminal end of IL-6 helix A and the SOMAmer backbone phosphate between G5 and G6 imparts additional protection from solvent for the hydrophobic nucleotides. See FIG. 15C. The modified nucleotide cluster comprised of positions 7, 8, 12 and 30 clearly serves a dual function of an intramolecular structural foundation for the SOMAmer itself as well as a hydrophobic surface that contacts the protein. Y31 on IL-6 helix A stacks on top of the uridine ring of Nap-dU12 adding the fourth aromatic ring to the string of π-stacking interactions that also involves Bn8 and the base of Bn-dU7. See FIG. 15D. The amide arm of Nap-dU12 reaches across to helix C on IL-6, where the naphthyl group has a hydrophobic interaction with the methylene side chain of M117, in addition to the π-stacking interaction the uridine ring of Bn-dU8. See FIGS. 15B and 14C. Additionally, Bn7 stacks against the side chain of R24, has an edgewise interaction with K27 and hydrogen bonds through the carbonyl oxygen of the amide linker to R30. Bn7 and Bn8 are also involved in edge-to-face interactions with F125 on helix C. See FIG. 15F.

Domain 2: Stem-loop

Figure 16:
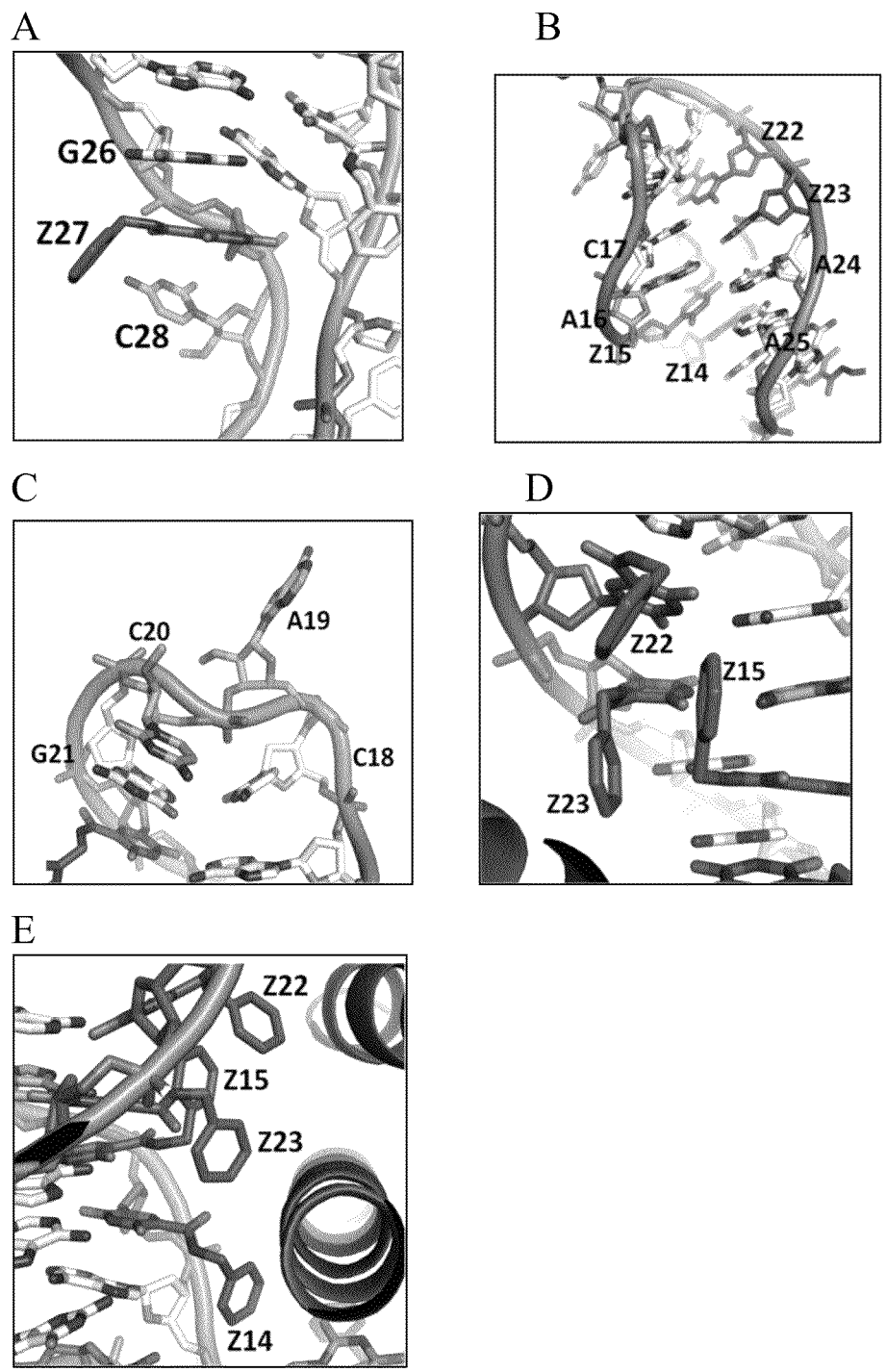
FIG. 16 shows the stem-loop motif (domain 2), as described in Example 13. (A) The bottom of the stem loop of domain 2 contains two unpaired bases at Bn27 and C28. The uridine ring of Bn27 stacks with G26 however the benzyl group and C28 are extruded. (B) Base pairing in the stem loop. There are four Watson-Crick base pairs in the SOMAmer stem loop between Bn-dU14:A25, Bn-dU15:A24, Bn-dU23:A16, and Bn-dU22:C17. (C) The SOMAmer loop region contains four unpaired bases, C18 through G21. A19 and C20 are extruded bases. (D) The hydrophobic cluster of benzyl groups from Bn15, Bn22 and Bn23. (E) The uridine ring of Bn14 stacks with the amide of Bn15 while the benzyl group points opposite the hydrophobic cluster of Bn15, Bn22 and Bn23.

Domain 2 of the SOMAmer contains a stem-loop which is primarily B-form DNA but with a slight left-handed twist in the loop region. At the bottom of the stem on the 3' end are two unpaired bases: Bn-dU27 and C28. Although formally assigned to domain 2, these two unpaired bases, along with G26 and A13 on the 5' end of the stem, can be thought of as a flexible hinge between the two domains. G26 and the uridine ring of Bn-dU27 have a weak stacking interaction while the benzyl group of Bn-dU27 (Bn27) is completely solvent exposed. See FIG. 16A. Similarly, C28 makes no intra- or intermolecular contacts and is also extruded into the solvent. These two unpaired bases are followed by a sheared G-A base pair between G26 and A13 (shear: 6.2 Å; buckle: −34°; propeller: −11°) and four Watson-Crick base pairs between Bn-dU14 and A25, Bn-dU15 and A24, A16 and Bn-dU23, and A11 and Bn-dU22 that adopt B-form helix conformation. See FIG. 16B. The Watson-Crick base pairs also exhibit a range of buckling and propeller twist parameters that are disparate from ideal B-form angles with an average buckling of −14° (standard deviation (s.d.) 26) and an average propeller twist of −11° (s.d 9.2). The tetraloop at the top of the stem is formed with C18, A19, C20 and G21. Formally within the tetraloop, C18 and G21 form a substantially distorted base pair characterized by two stretched H-bonds (3.5 Å and 3.8 Å) with irregular shearing (1.1 Å), stretching (3.4 Å), stagger (1.4 Å), buckling (32°), propeller (−52°) and opening (−61°) parameters. The H-bonds are formed between the Watson-Crick face of C18 and the Hoogsteen edge of G21 while the Watson-Crick face of G21 is involved in a crystal contact to C20 of a symmetry mate. Additionally, the syn conformation of G21 results in a somewhat left-handed twist (−18°) between the A17:Bn-dU21 and the C18:G21 base-pairs. The G21 base stacks with Bn-dU22 in the stem, however, C18, A19 and C20 are not involved in any intra- or intermolecular contacts. The C20 base is partially extruded into the solvent while A19 is completely solvent exposed. See FIG. 16C.

The domain 2 stem-loop structure contains five modified benzyl nucleotides at positions 14, 15, 22, 23 and 27. Of these, only Bn-dU27 in the hinge region does not contact the protein. The remaining modified nucleotides all participate in base pairing through the uridine ring, while the benzyl groups are directed out of the helix and towards the protein. A hydrophobic pocket is created through the non-stacking clustered arrangement of benzyls from Bn22, Bn23 and Bn15. See FIG. 16D. The uridine ring of Bn14 stacks with the amide of Bn15 and the benzyl group points away from the benzyl cluster of Bn22, Bn23 and Bn15 but towards the IL-6 protein. See FIG. 16E. The Bn-dU14 nucleotide bridges the protein interactions of domain 1 and domain 2 while not participating in either of the hydrophobic clusters.

IL-6:SOMAmer Interactions in Domain 2

Figure 17:
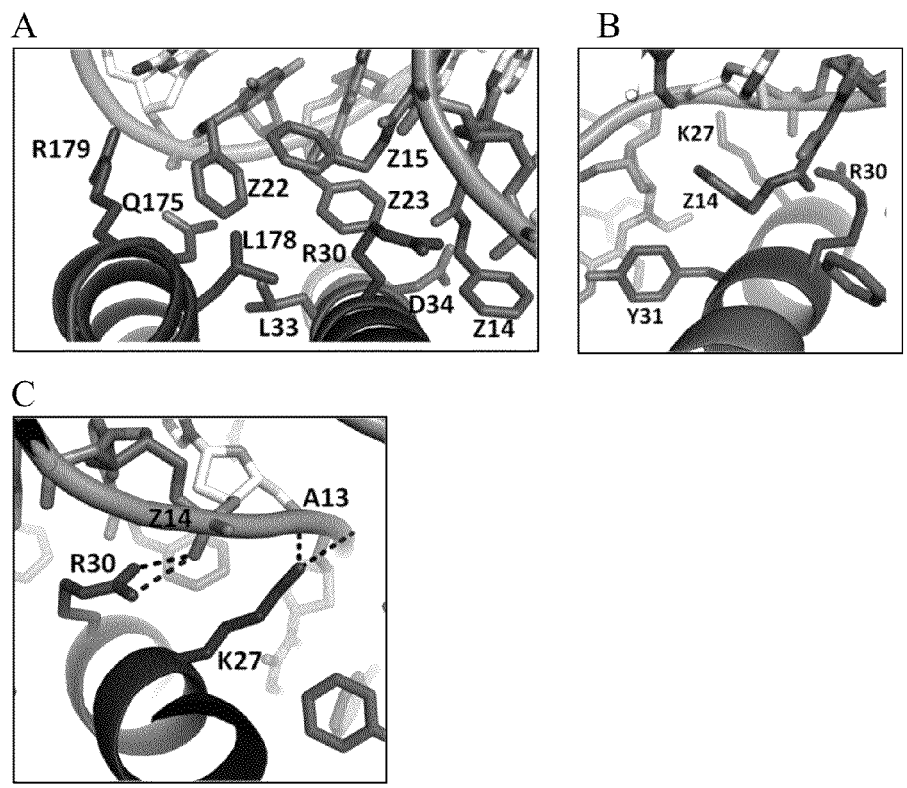
FIG. 17 shows that protein-SOMAmer contacts in domain 2 are primarily hydrophobic, as described in Example 13. (A) Bn15, Bn22 and Bn23 have hydrophobic interactions with the methylene side chains of residues on helix A and helix D on the IL-6 protein. (B) Bn14 has edge-to-face interactions with Y31 as well as edgewise interactions with the non-polar side chains of K27 and R30. (C) Salt bridges between K27 and R30 on IL-6 and the SOMAmer backbone at A13 and Bn-dU14.

The majority of IL-6 interactions with domain 2 of the SOMAmer are hydrophobic in nature. The benzyl groups of Bn15, Bn22 and Bn23 are nestled against the helices on IL-6 in a hydrophobic pocket created by the non-polar portion of the side chains of R30, L33 and D34 on helix A and Q175, L178 and R179 on helix D. See FIG. 17A. The benzyl group of Bn14, which is outside the hydrophobic cluster, has edge-to-face interactions with Y31 and edgewise interactions with the methylene side chains of K27 and R30. See FIG. 17B. Two salt bridges also exist in this domain between the backbone A13 phosphate and K27, and Bn-dU14 phosphate and R30, with both amino acid residues from helix A. See FIG. 17C. A complete list of all IL-6:SOMAmer interactions is summarized in Table 9. The calculated solvent accessible surface area (S.A.S) is 8696 Å$^2$ for the IL-6 protein, 6672 Å$^2$ for the SOMAmer, and 12872 Å$^2$ for the complex. The solvent excluded surface area of the interface is therefore 1248 Å$^2$, calculated as [(S.A.S$_{IL-6}$+S.A.S$_{SOMAmer}$)−S.A.S$_{Complex}$]/2. This value is similar to the previously reported solvent excluded area of PDGF-BB SOMAmer of 1225 Å$^2$ (Davies et al., Proc. Natl. Acad. Sci. USA. 2012. 109: 19971-19976).

TABLE 9

Protein-SOMAmer interactions
Protein-SOMAmer Interactions

| | Salt Bridges | |
|---|---|---|
| 1. | Arg24 to SOMAmer backbone phosphate at G5-G6 | |
| 2. | Arg30 to SOMAmer backbone phosphate at Z14 | |
| 3. | Lys27 to SOMAmer backbone phosphate at A13 | |
| | Hydrogen Bonds | |
| 1. | G29 Hoogsteen face to Arg16 | |
| 2. | BndU7 carbonyl to Arg30 | |
| | Hydrophobic Interactions | |
| 1. | BndU7 | methylene side chain of Arg24 |
| | | methylene side chain of Lys27 |
| | | edge-to-face with Phe125 |
| 2. | BndU8 | edge-to-face with Phe125 |
| 3. | NapdU12 | uridine stacks with Tyr31 |
| | | benzyl to methylene side chain of Met117 |
| 4. | BndU14 | methylene side chain of Lys27 |
| | | methylene side chain of Arg30 |
| | | edge-to-face with Tyr31 |
| 5. | BndU15 | methylene side chain of Arg30 |
| | | methylene side chain of Leu178 |
| 6. | BndU22 | methylene side chain of Gln175 |
| | | methylene side chain of Leu178 |
| | | methylene side chain of Arg179 |
| 7. | BndU23 | methylene side chain of Arg30 |
| | | methylene side chain of Asp34 |
| 8. | BndU30 | methylene side chain of Arg16 |

Receptor Mimicry

Figure 18:
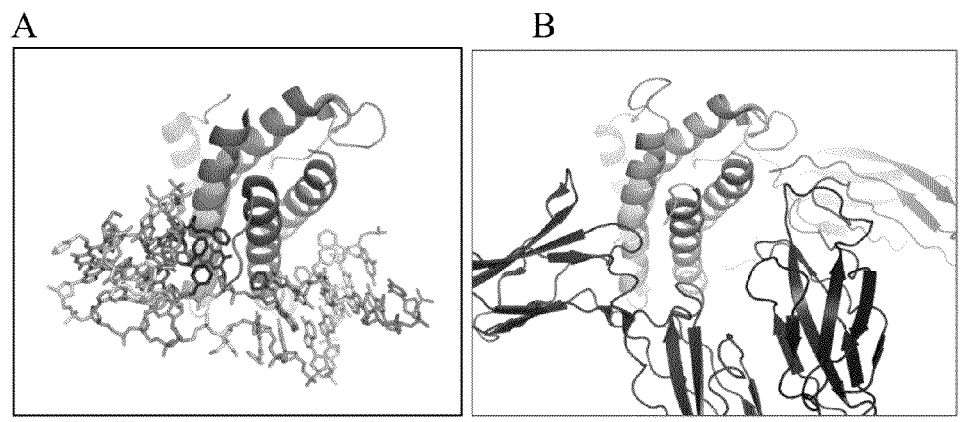
FIG. 18 shows overlap of SOMAmer and receptor binding sites on IL-6, as described in Example 13. Global views of IL-6 interactions with the SOMAmer (A) and the IL-6 receptors IL-6Rα and gp130 (B).

The binding interface on IL-6 engaged by the SOMAmer overlaps extensively with the regions involved in IL-6 binding to its two cell-surface receptors, IL-6Rα and gp130. Domain 1 of the SOMAmer occupies the binding site exclusively involved in binding to gp130 whereas domain 2 primarily occupies the binding site for IL-6Rα. See FIGS. 18A and 18B. The degree to which the SOMAmer engages IL-6 in a manner that resembles the receptors is only partly evident when considering global overlap of the binding surfaces. Consideration of specific interactions illustrates an even greater extent of receptor mimicry.

Figure 19:
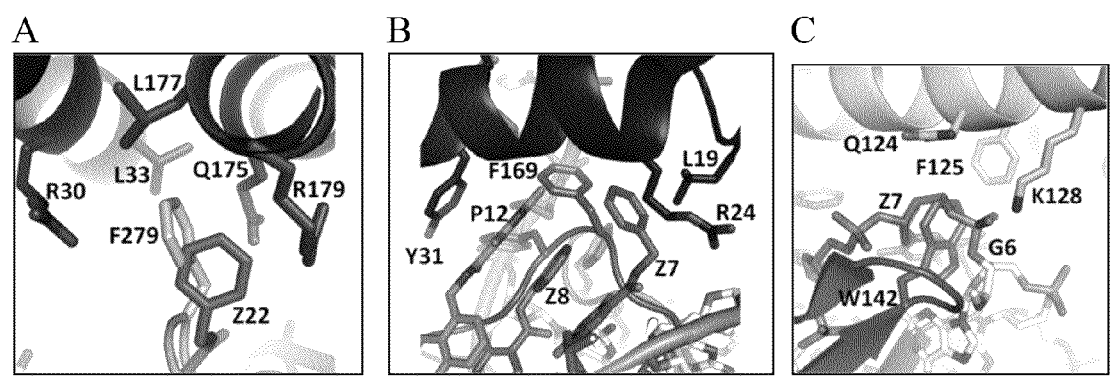
FIG. 19 shows detail of SOMAmer and receptor binding sites, as described in Example 13. (A) Residue F279 on IL-6Rα and Bn22 on the SOMAmer recognize the same binding site on IL-6 helices A and D. (light green denotes IL-6Rα, other colors as in other figures). (B) The SOMAmer and gp130 recognize the same binding site on the IL-6 protein. F169 of gp130 and Bn7, Bn8 and Nap 12 of the SOMAmer interact with Y31 and the methylene side chains of L19 and R24 on helix A of IL-6. (rose=gp130). (C) The SOMAmer backbone between G6 and Bn7 in the IL-6-SOMAmer structure occupies the same space as W142 in the IL-6/IL-6Rα/gp130 structure.

The hexameric structure of IL-6 bound to the IL-6Rα receptor and the signaling receptor gp130 identified three surfaces on IL-6 involved in protein-protein interactions (Boulanger, M. J., et al., Science. 2003. 300: p 2101-2104). Site I consists of helices A and D, which interact with IL-6Rα to bury 1200 Å$^2$. Key residues on IL-6Rα at this interface are F229 and F279. F229 has edgewise interactions with the methylene side chains of R179 and Q183 on helix D of IL-6. F279 also interacts with the methylene side chain of R179 on the opposite face and sits in a hydrophobic pocket created by the non-polar side chains of R179, Q175, L178 on helix D and L33 and R30 on helix A. This is the same hydrophobic pocket occupied by Bn22 within domain 1 of the SOMAmer structure, where the only difference is the rotation of the benzyl group of Bn22 by ~70° relative to F279. See FIG. 19A. There is not a nucleotide in the SOMAmer that interacts on the same surface of IL-6 as F229.

The IL-6/IL-6Rα heterodimer is the first complex to form, followed by gp130 binding to sites IIa/b on IL-6 and IL-6Rα, respectively. Site IIa also buries ~1200 Å$^2$ and includes helices A and C of IL-6. Residue F169 on gp130 interacts with a surface on helix A containing L19, R24, K27, and Y31, primarily through hydrophobic interactions with non-polar side chains. These are many of the same residues involved in SOMAmer binding to IL-6. Moreover, F169 occupies the same binding pocket in the IL-6/IL-6Rα/gp130 structure as Bn7, Bn8 and Nap12 in the IL-6-SOMAmer structure. See FIG. 19B. The SOMAmer backbone between G6 and BndU7 in the IL-6:SOMAmer structure occupies the same site as W142 on gp130 in the hexameric structure. See FIG. 19C. W142 has an edge-to-face interaction with F125 of IL-6 as well as hydrophobic interactions with the non-polar side chains of Q124, and K128 on helix C. See FIG. 19C. The second gp130 molecule in the hexameric structure binds to site III on IL-6, which is located at the opposite pole of the four helix bundle and contains no overlapping binding sites with the SOMAmer. The extensive overlap of surfaces on IL-6 engaged by the SOMAmer and the receptors is consistent with the observed ability of the SOMAmer to inhibit IL-6-mediated effects.

Activity of the G-quartet Domain Fragment and its Post-SELEX Modification

To determine whether the two domains observed in the SOMAmer represent independent binding units, we synthesized several variants of domains 1 and 2. Fragments representing various forms of the stem-loop domain did not show appreciable binding affinity for IL-6 at protein concentrations up to 1 μM (data not shown). In contrast, a fragment containing the G-quartet domain comprised of positions 1-12 and 29-32, with a C3 spacer connecting the two sequence regions (2573-20_324 (SEQ ID NO: 319)) exhibited a binding affinity to IL-6 of approximately 200 nM. This 16-nucleotide fragment corresponds to the entire G-quartet domain, in which the C3 spacer replaces the stem-loop domain that connects the two regions of the G-quartet in the full-length SOMAmer. The binding affinity of this G-quartet fragment is about 1000-fold lower compared to the full-length SOMAmer. Nevertheless, in terms of free energy of binding, ΔG, which is −13.7 kcal/mol for the full-length SOMAmer and −9.5 kcal/mol for the G-quartet fragment, the G-quartet domain appears to make a major contribution to the overall binding affinity of the full-length SOMAmer. A sequence-scrambled analog of the G-quartet fragment shown no binding up to IL-6 concentration of 1 μM.

Aside from maintaining a substantial fraction of the binding affinity, the G-quartet fragment also maintains its ability to inhibit IL-6 mediated effects in vitro, in the Gene Reporter Assay described above.

Starting with 2573-20_324 (SEQ ID NO: 319), we examined the effect of substituting each of the five modified nucleotides with a collection of alternative 5-position substituents. The effect of fifteen alternative 5-position substituents introduced at each of the five modified dU residues is summarized in FIG. 22, where the change in affinity from the reference (parent) sequence is expressed as the ratio of dissociation constants ($K_d$ value of variants divided by the $K_d$ value of a reference ligand 2573-20_324 (SEQ ID NO: 319)). Within the set of fifteen alternative moieties, the five modified nucleotide positions of the G-quartet fragment vary with regard to their sensitivity to substitutions. Position 9 is the most tolerant to substitution, with thirteen out of fifteen replacements being essentially neutral and showing less than 2-fold effect on binding affinity. This is not unexpected in view of the fact that modified nucleotide side chain at position 9 is not in contact with the protein and instead is exposed to the solvent. At positions 8 and 12, however, most substitutions are somewhat unfavorable and none lead to an improvement in affinity (position 12 is already changed to naphthyl from benzyl in 2573-20_324 (SEQ ID NO: 319) versus 3573-20 (SEQ ID NO: 7). This is also true for position 30, except for a replacement of benzyl group with the smaller isobutyl group which leads to an improvement in affinity of about 6-fold. In contrast, position 7 is somewhat sensitive to modification with notable affinity changes observed in both favorable and unfavorable directions. Replacement of aromatic benzyl group with non-aromatic side chains is generally unfavorable at position 7 and leads to a reduction in affinity of >100-fold. Replacement with larger aromatic functional groups, on the other hand, results in affinity improvement. With one such substitution (MBn-dU), affinity improvement of 100-fold is observed. In terms of absolute affinity, this translates to a $K_d$ value 1 nM. The improvement in binding affinity is also reflected in the 20-fold improvement in inhibitory activity in vitro.

Example 14

Analysis of SELEX Pools to Determine Binding Consensus

To evaluate more completely the sequences within the 2573-20 SOMAmer family and the 2574-49 SOMAmer family, the enriched pools were sequenced using 454 pyrosequencing technology as described above in Example 4.

The sequences were then analyzed to identify additional IL-6-binding SOMAmers with a G-quartet motif similar to the motif in 2573-20_136 (SEQ ID NO: 101). Several more unique SOMAmers sequences that appear to have G-quartet motifs were identified, many of which were present in the final SELEX pool in multiple copies. FIG. 23 shows exemplary unique SOMAmer sequences that appear to have G-quartet motifs, representing over 1600 clones in the final SELEX pool. For each SOMAmer, only the sequence of the random region is shown.

FIG. 25 shows exemplary unique SOMAmer sequences that are similar to 2574-49. For each SOMAmer, only the sequence of the random region is shown.

Example 15

Effect of SOMAmer 2573-20_136 (SEQ ID NO: 101) on Joint Inflammation in Cynomolgus Monkeys with Collagen-Induced Arthritis IL-6 is a key mediator of the inflammatory response associated with rheumatoid arthritis. Collagen-induced arthritis (CIA) is an established autoimmune model for studying rheumatoid arthritis in cynomolgus monkeys. The effect of PEG-N-2573-20_136 (2573-20_136 (SEQ ID NO: 101) with a 40 kDa PEG conjugated to the 5' terminus) on the severity of joint inflammation was evaluated in this model.

Female cynomolgus monkeys (*Macaca fascicularis*) aged 3-5 years were purchased from Guangxi Grandforest Scientific Primate Company, Ltd (Guangxi, China). All procedures involving animals were approved by the animal care and use committee of the laboratory. Bovine type II collagen (4 mg/mL, K41S type II collagen, Collagen Research Center, Tokyo, Japan) and Freund's complete adjuvant (Becton Dickinson, Grayson, Ga., USA) were mixed in equal proportions and suspended using a cooled syringe to prepare an emulsion. The emulsion was injected intradermally into 19 sites on the back and one site at the base of the tail (total 2 mL/body). At 21 days after the first sensitization, 2 mL of the emulsion was administered again. The second sensitization was performed in the same manner as the first one. PEG-N-2573-20_136 (2573-20_136 (SEQ ID NO: 101) with a 40 kDa PEG conjugated to the 5' terminus) (1 or 10 mg/mL/kg) was injected into the forearm cephalic vein four times a day for 11 and one half days (46 total injections) after the first sensitization. The control group was administered the vehicle that was used for PEG-N-2573-20_136 dosing solution in the same manner (1 mL/kg).

At 6 days before, and at 6, 13, 20, 27 and 34 days after the first sensitization, arthritis scores (swelling and rigidity levels of joints) were evaluated for all monkeys. Examined joints included the metacarpophalangeal, proximal interphalangeal, distal interphalangeal, wrist, ankle, elbow, and knee (total 64 joints/body). After anesthetization by intramuscular injection of ketamine hydrochloride (Kamud Drugs Pvt., Ltd., 0.2 mL/kg, 10 mg/kg), the examination was conducted in accordance with the evaluation criteria for swelling and rigidity shown below; Score 0: no abnormality, Score 1: swelling not visible but can be determined by touch, Score 2: swelling slightly visible and can be confirmed by touch, Score 3: swelling clearly visible and joint can be completely flexed, Score 4: swelling clearly visible but joint cannot be completely flexed, Score 5: rigidity of the joints. Arthritis score of each animal was the sum of individual scores of the 64 joints. Arthritis score was judged in a blind manner by a designated technician.

Figure 26:
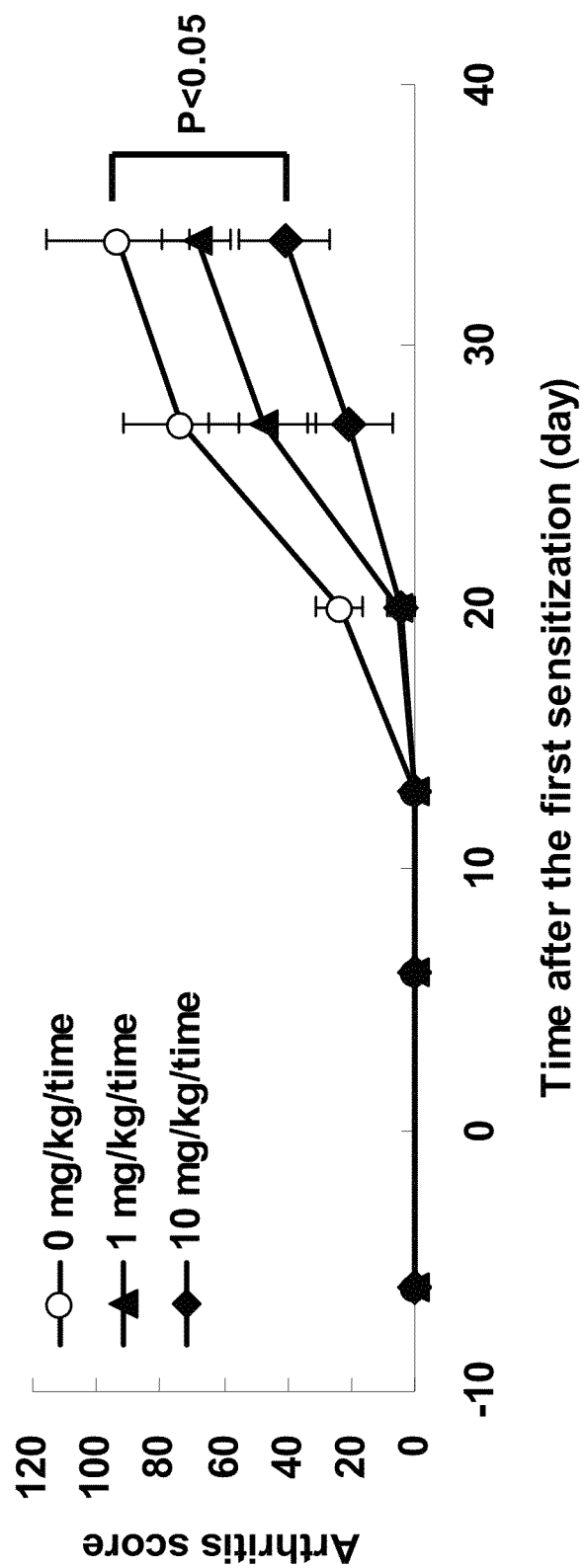
FIG. 26 shows the effect of PEG-N-2573-20_136 (2573-20_136 (SEQ ID NO: 101) with a 40 kDa PEG conjugated to the 5' terminus) on joint inflammation in cynomolgus monkeys with collagen-induced arthritis.

Results of arthritis scores are illustrated in FIG. 26. Each bar represents the mean±standard error (N=4) of arthritis score in each group. A statistically significant decrease was noted in the 10 mg/kg/time group of PEG-N-2573-20_136 (2573-20_136 (SEQ ID NO: 101) with a 40 kDa PEG conjugated to the 5' terminus) by repeated measures ANOVA followed by Dunnett's test (P<0.05 vs 0 mg/kg/time group).

Example 16

Additional Modification of 2573-20_136 (SEQ ID NO: 101) to Improve Nuclease Stability and Antagonist Activity In some instances, nuclease protection can be achieved with 2'-O-methyl, 2'-fluoro, and phosphorothioate (PS) linkages. Variants of 2573-20_136 (SEQ ID NO: 101) with combinations of 2'-O-methyl U, phosphorothiate, C3-spacer, and HEG substitutions were screened for affinity and inhibition activity to identify additional active IL-6 inhibitors. Alternative U modifications were also tested at certain positions. See FIG. 24. Table 10 shows a list of variants that were found to have an $IC_{50}$ ranging from $10^{-11}$ M to $10^{-8}$ M. SOMAmer 2573-20_745 (SEQ ID NO: 218) has a protective backbone substitution at every position (18 2'-O-methyl, 12 phosphorothioate, and a HEG replacing dA19 and dC20), and retains IL-6 antagonist activity ($IC_{50}$=4×10$^{-9}$ M in the Gene Reporter Assay). Table 11 shows a list of variants that were found to have an $IC_{50}$ greater than $10^{-8}$ M.

TABLE 10

Variants of 2573-20 136 (SEQ ID NO: 101) with $IC_{50}$ ranging from $10^{-11}$ M to $10^{-8}$ M.

| Aptamer | Sequence | $IC_{50}$ (M) | SEQ ID NO |
|---|---|---|---|
| 2573-20_135 | G-G-$C^1$-A-G-$G^1$-Bn-Bn-Bn-G-G-Bn-A-Bn-Bn-$A^1$-A-C-$A^1$-$C^1$-G-Bn-Bn-A-A-G-Bn-$C^1$-G-Bn-G-G | 2.4E-10 | 100 |
| 2573-20_136 | G-G-$C^1$-A-G-$G^1$-Bn-Bn-Pe-G-G-Nap-A-Bn-Bn-$A^1$-A-C-$A^1$-$C^1$-G-Bn-Bn-A-A-G-Bn-$C^1$-G-Bn-G-G | 5.0E-10 | 101 |
| 2573-20_197 | G-G-$C^1$-A-G-$G^1$-Bn-Bn-Pe-G-G-Nap-A-Bn-Bn-$A^1$-A-C-$A^1$-$C^1$-G-Bn-Bn-A-A-G-C3-$C^1$-G-Bn-G-G | 6.5E-10 | 102 |
| 2573-20_198 | G-G-$C^1$-A-G-$G^1$-Bn-Bn-Pe-G-G-Nap-A-Bn-Bn-$A^1$-A-C-$A^1$-$C^1$-G-Bn-Bn-A-A-G-$U^1$-$C^1$-G-Bn-G-G | 1.2E-10 | 103 |
| 2573-20_199 | G-G-$C^1$-A-G-$G^1$-Bn-Bn-Pe-G-G-Nap-A-Bn-Bn-$A^1$-A-C-$A^1$-$C^1$-G-Bn-Bn-A-A-G-Bn-C3-G-Bn-G-G | 2.7E-10 | 104 |
| 2573-20_200 | G-G-$C^1$-A-G-$G^1$-Bn-Bn-Pe-G-G-Nap-A-Bn-Bn-$A^1$-A-C-$A^1$-$C^1$-G-Bn-Bn-A-A-G-C3-C3-G-Bn-G-G | 5.5E-10 | 105 |
| 2573-20_202 | G-G-$C^1$-A-G-$G^1$-Bn-Bn-Pe-G-G-Nap-A-Bn-Bn-$A^1$-A-C-$A^1$-$C^1$-G-Bn-Bn-A-A-G-Heg-G-Bn-G-G | 6.9E-10 | 106 |
| 2573-20_203 | G-G-$C^1$-A-G-$G^1$-Bn-Bn-Pe-G-G-Nap-A-Bn-Bn-$A^1$-A-C-Heg-G-Bn-Bn-A-A-G-Bn-$C^1$-G-Bn-G-G | 2.2E-10 | 107 |
| 2573-20_204 | G-G-$C^1$-A-G-$G^1$-Bn-Bn-Pe-G-G-Nap-A-Bn-Bn-$A^1$-A-Heg-Bn-Bn-A-A-G-Bn-$C^1$-G-Bn-G-G | 4.9E-10 | 108 |
| 2573-20_205 | G-G-$C^1$-A-G-$G^1$-Bn-Bn-Pe-G-G-Nap-A-Bn-Bn-$A^1$-A-C3-C3-Bn-Bn-A-A-G-Bn-$C^1$-G-Bn-G-G | 5.1E-10 | 109 |
| 2573-20_208 | G-G-$C^1$-A-G-$G^1$-Bn-Bn-Pe-G-G-Nap-A-Bn-Bn-$A^1$-A-C-Heg-BT-Bn-Bn-A-A-G-Bn-$C^1$-G-Bn-G-G | 5.1E-10 | 110 |
| 2573-20_209 | G-G-$C^1$-A-G-$G^1$-Bn-Bn-Pe-G-G-Nap-A-Bn-Bn-$A^1$-A-C-Heg-MBn-Bn-Bn-A-A-G-Bn-$C^1$-G-Bn-G-G | 5.5E-10 | 111 |
| 2573-20_210 | G-G-$C^1$-A-G-$G^1$-Bn-Bn-Pe-G-G-Nap-A-Bn-Bn-$A^1$-A-C-Heg-NE-Bn-Bn-A-A-G-Bn-$C^1$-G-Bn-G-G | 6.1E-10 | 112 |
| 2573-20_217 | G-G-$C^1$-A-G-$G^1$-Bn-Bn-$U^1$-G-G-Nap-A-Bn-Bn-$A^1$-A-C-$A^1$-$C^1$-G-Bn-Bn-A-A-G-Bn-$C^1$-G-Bn-G-G | 5.6E-10 | 113 |
| 2573-20_235 | G-G-$C^1$-A-G-$G^1$-Bn-Bn-Pe-G-G-Nap-A-Bn-Bn-$A^1$-A-Heg-Pe-Bn-A-A-G-Bn-$C^1$-G-Bn-G-G | 4.1E-10 | 114 |
| 2573-20_258 | G-G-$C^1$-A-G-$G^1$-$U^1$-Bn-Pe-G-G-Nap-A-Bn-Bn-$A^1$-A-C-$A^1$-$C^1$-G-Bn-Bn-A-A-G-Bn-$C^1$-G-Bn-G-G | 1.5E-10 | 115 |
| 2573-20_259 | G-G-$C^1$-A-G-$G^1$-Bn-$U^1$-Pe-G-G-Nap-A-Bn-Bn-$A^1$-A-C-$A^1$-$C^1$-G-Bn-Bn-A-A-G-Bn-$C^1$-G-Bn-G-G | 4.2E-09 | 116 |
| 2573-20_263 | G-G-$C^1$-A-G-$G^1$-Bn-Bn-Pe-G-G-Nap-A-Bn-$U^1$-$A^1$-A-C-$A^1$-$C^1$-G-Bn-Bn-A-A-G-Bn-$C^1$-G-Bn-G-G | 1.4E-09 | 117 |
| 2573-20_264 | G-G-$C^1$-A-G-$G^1$-Bn-Bn-Pe-G-G-Nap-A-Bn-Bn-$A^1$-A-C-$A^1$-$C^1$-G-$U^1$-Bn-A-A-G-Bn-$C^1$-G-Bn-G-G | 1.5E-09 | 118 |
| 2573-20_265 | G-G-$C^1$-A-G-$G^1$-Bn-Bn-Pe-G-G-Nap-A-Bn-Bn-$A^1$-A-C-$A^1$-$C^1$-G-Bn-$U^1$-A-A-G-Bn-$C^1$-G-Bn-G-G | 1.6E-09 | 119 |
| 2573-20_268 | G-G-$C^1$-A-G-$G^1$-Bn-Bn-Pe-G-G-Nap-A-Bn-Bn-$A^1$-A-Heg-Bn-Bn-$A^1$-A-G-$U^1$-$C^1$-G-Bn-G-G | 1.9E-09 | 120 |
| 2573-20_273 | G-G-$C^1$-A-G-$G^1$-Bn-Bn-Pe-G-G-Nap-A-Bn-Bn-$A^1$-A-Heg-Tyr-Bn-$A^1$-A-G-$U^1$-$C^1$-G-Bn-G-G | 5.6E-10 | 121 |
| 2573-20_274 | G-G-$C^1$-A-G-$G^1$-Bn-Bn-Pe-G-G-Nap-A-Bn-Bn-$A^1$-A-Heg-Bn-Tyr-$A^1$-A-G-$U^1$-$C^1$-G-Bn-G-G | 1.7E-09 | 122 |
| 2573-20_278 | G-G-$C^1$-A-G-$G^1$-Bn-Bn-Pe-G-G-Nap-A-Bn-Bn-$A^1$-A-Heg-FBn-Bn-$A^1$-A-G-$U^1$-$C^1$-G-Bn-G-G | 4.4E-10 | 123 |

TABLE 10-continued

Variants of 2573-20 136 (SEQ ID NO: 101) with IC$_{50}$ ranging from $10^{-11}$ M to $10^{-8}$ M.

| Aptamer | Sequence | IC$_{50}$ (M) | SEQ ID NO |
|---|---|---|---|
| 2573-20_280 | G-G-C$^1$-A-G-G$^1$-Bn-Bn-Pe-G-G-Nap-A-Bn-Bn-A$^1$-A-Heg-FBn-Tyr-A$^1$-A-G-Bn-C$^1$-G-Bn-G-G | 3.4E-10 | 124 |
| 2573-20_282 | G-G-C$^1$-A-G-G$^1$-Bn-Bn-Pe-G-G-Nap-A-Bn-Bn-A$^1$-A-C-Heg-G-Bn-Bn-A$^1$-A-G-U$^1$-C$^1$-G-Bn-G-G | 1.2E-11 | 125 |
| 2573-20_283 | G-G-C$^1$-A-G-G$^1$-Bn-Bn-U$^1$-G-G-Nap-A-Bn-Bn-A$^1$-A-C-Heg-G-Bn-Bn-A$^1$-A-G-Bn-C$^1$-G-Bn-G-G | 5.1E-11 | 126 |
| 2573-20_284 | G-G-C$^1$-A-G-G$^1$-Bn-Bn-U$^1$-G-G-Nap-A-Bn-Bn-A$^1$-A-C-Heg-G-Bn-Bn-A$^1$-A-G-U$^1$-C$^1$-G-Bn-G-G | 8.9E-11 | 127 |
| 2573-20_285 | G-G-C$^1$-A-G-G$^1$-Bn-Bn-U$^1$-G-G-Nap-A-Bn-Bn-A$^1$-A-C-Heg-G-FBn-Bn-A$^1$-A-G-U$^1$-C$^1$-G-Bn-G-G | 2.2E-09 | 128 |
| 2573-20_286 | G-G-C$^1$-A-G-G$^1$-Bn-Bn-U$^1$-G-G-Nap-A-Bn-Bn-A$^1$-A-C-Heg-G-Bn-Tyr-A$^1$-A-G-U$^1$-C$^1$-G-Bn-G-G | 3.8E-10 | 129 |
| 2573-20_287 | G-G-C$^1$-A-G-G$^1$-Bn-Bn-U$^1$-G-G-Nap-A-Bn-Bn-A$^1$-A-C-Heg-G-Tyr-Bn-A$^1$-A-G-U$^1$-C$^1$-G-Bn-G-G | 3.9E-10 | 130 |
| 2573-20_288 | G-G-C$^1$-A-G-G$^1$-Bn-Bn-U$^1$-G-G-Nap-A-Bn-Bn-A$^1$-A-C-Heg-G-FBn-Tyr-A$^1$-A-G-U$^1$-C$^1$-G-Bn-G-G | 6.0E-10 | 131 |
| 2573-20_289 | G-G-C$^1$-A-G-G$^1$-Bn-Bn-Pe-G-G-Nap-A-Bn-Bn-A$^1$-A-C-A$^1$-C$^1$-G-Bn-Bn-A$^1$-A-G-U$^1$-C3-G-Bn-G-G | 1.1E-10 | 132 |
| 2573-20_290 | G-G-C$^1$-A-G-G$^1$-Bn-Bn-U$^1$-G-G-Nap-A-Bn-Bn-A$^1$-A-C-A$^1$-C$^1$-G-Bn-Bn-A$^1$-A-G-U$^1$-C3-G-Bn-G-G | 6.9E-10 | 133 |
| 2573-20_291 | G-G-C$^1$-A-G-G$^1$-Bn-Bn-Pe-G-G-Nap-A-Bn-Bn-A$^1$-A-C-Heg-G-Bn-Bn-A$^1$-A-G-U$^1$-C3-G-Bn-G-G | 6.8E-11 | 134 |
| 2573-20_292 | G-G-C$^1$-A-G-G$^1$-Bn-Bn-U$^1$-G-G-Nap-A-Bn-Bn-A$^1$-A-C-Heg-G-Bn-Bn-A$^1$-A-G-U$^1$-C3-G-Bn-G-G | 1.4E-09 | 135 |
| 2573-20_293 | G-G-C$^1$-A-G-G$^1$-Bn-Bn-Pe-G-G-Nap-A-Bn-Bn-A$^1$-A-Heg-Bn-Bn-A$^1$-A-G-U$^1$-C3-G-Bn-G-G | 1.1E-09 | 136 |
| 2573-20_297 | G-G-C$^1$-A-G-G$^1$-Bn-Bn-Pe-G-G-Nap-A-Bn-Bn-A$^1$-A-C-Heg-G-Bn-Bn-A$^1$-A-G-Heg-G-Bn-G-G | 5.1E-09 | 137 |
| 2573-20_300 | G$^0$-G-C$^1$-A-G-G$^1$-Bn-Bn-Pe-G-G-Nap-A-Bn-Bn-A$^1$-A-C-A$^1$-C$^1$-G-Bn-Bn-A$^1$-A-G-Bn-C$^1$-G-Bn-G-G | 7.4E-09 | 138 |
| 2573-20_301 | G-G$^0$-C$^1$-A-G-G$^1$-Bn-Bn-Pe-G-G-Nap-A-Bn-Bn-A$^1$-A-C-A$^1$-C$^1$-G-Bn-Bn-A$^1$-A-G-Bn-C$^1$-G-Bn-G-G | 4.1E-09 | 139 |
| 2573-20_304 | G-G-C$^1$-A-G-G$^1$-Bn-Bn-Pe-G-G$^0$-Nap-A-Bn-Bn-A$^1$-A-C-A$^1$-C$^1$-G-Bn-Bn-A$^1$-A-G-Bn-C$^1$-G-Bn-G-G | 1.3E-09 | 140 |
| 2573-20_305 | G-G-C$^1$-A-G-G$^1$-Bn-Bn-Pe-G-G-Nap-A-Bn-Bn-A$^1$-A-C-A$^1$-C$^1$-G$^0$-Bn-Bn-A$^1$-A-G-Bn-C$^1$-G-Bn-G-G | 4.3E-09 | 141 |
| 2573-20_306 | G-G-C$^1$-A-G-G$^1$-Bn-Bn-Pe-G-G-Nap-A-Bn-Bn-A$^1$-A-C-A$^1$-C$^1$-G-Bn-Bn-A$^1$-A-G$^0$-Bn-C$^1$-G-Bn-G-G | 2.6E-09 | 142 |
| 2573-20_307 | G-G-C$^1$-A-G-G$^1$-Bn-Bn-Pe-G-G-Nap-A-Bn-Bn-A$^1$-A-C-A$^1$-C$^1$-G-Bn-Bn-A$^1$-A-G-Bn-C$^1$-G$^0$-Bn-G-G | 4.2E-09 | 143 |
| 2573-20_309 | G-G-C$^1$-A-G-G$^1$-Bn-Bn-Pe-G-G-Nap-A-Bn-Bn-A$^1$-A-C-A$^1$-C$^1$-G-Bn-Bn-A$^1$-A-G-Bn-C$^1$-G-Bn-G-G$^0$ | 2.0E-09 | 144 |
| 2573-20_310 | G-G-C$^1$-A$^0$-G-G$^1$-Bn-Bn-Pe-G-G-Nap-A-Bn-Bn-A$^1$-A-C-A$^1$-C$^1$-G-Bn-Bn-A$^1$-A-G-Bn-C$^1$-G-Bn-G-G | 2.6E-09 | 145 |
| 2573-20_311 | G-G-C$^1$-A-G-G$^1$-Bn-Bn-Pe-G-G-Nap-A$^0$-Bn-Bn-A$^1$-A-C-A$^1$-C$^1$-G-Bn-Bn-A$^1$-A-G-Bn-C$^1$-G-Bn-G-G | 5.1E-09 | 146 |
| 2573-20_312 | G-G-C$^1$-A-G-G$^1$-Bn-Bn-Pe-G-G-Nap-A-Bn-Bn-A$^1$-A$^0$-C-A$^1$-C$^1$-G-Bn-Bn-A$^1$-A-G-Bn-C$^1$-G-Bn-G-G | 8.3E-10 | 147 |

TABLE 10-continued

Variants of 2573-20 136 (SEQ ID NO: 101) with IC$_{50}$ ranging from $10^{-11}$ M to $10^{-8}$ M.

| Aptamer | Sequence | IC$_{50}$ (M) | SEQ ID NO |
|---|---|---|---|
| 2573-20_313 | G-G-C$^1$-A-G-G$^1$-Bn-Bn-Pe-G-G-Nap-A-Bn-Bn-A$^1$-A-C-A$^1$-C$^1$-G-Bn-Bn-A$^1$-A$^0$-G-Bn-C$^1$-G-Bn-G-G | 1.3E-09 | 148 |
| 2573-20_314 | G-G-C$^1$-A-G-G$^1$-Bn-Bn-Pe-G-G-Nap-A-Bn-Bn-A$^1$-A-C$^0$-A$^1$-C$^1$-G-Bn-Bn-A$^1$-A-G-Bn-C$^1$-G-Bn-G-G | 3.9E-10 | 149 |
| 2573-20_334 | G-G-C$^1$-A-G-G$^1$-Bn-Bn-Pe-G-G-Nap-A-Bn-Bn-A$^1$-A-Heg-Tyr-Bn-A$^1$-A-G-U$^1$-C$^1$-G-Bn-G-G | 1.9E-09 | 150 |
| 2573-20_337 | G-G-C$^1$-A-G-G$^1$-Bn-Bn-Pe-G-G-Nap-A-Bn-Bn-A$^1$-A-Heg-Tyr-Bn-A$^1$-A-G-U$^1$-C$^1$-G-Bn-G-G$^1$ | 4.3E-09 | 151 |
| 2573-20_340 | G-G-C$^1$-A-G-G$^1$-Bn-Bn-Pe-G-G-Nap-A-Bn-Bn-A$^1$-A$^1$-Heg-Tyr-Bn-A$^1$-A-G-U$^1$-C$^1$-G-Bn-G-G | 5.8E-10 | 152 |
| 2573-20_341 | G-G-C$^1$-A-G-G$^1$-Bn-Bn-Pe-G-G-Nap-A-Bn-Bn-A$^1$-A-Heg-Tyr-Bn-A$^1$-A$^1$-G-U$^1$-C$^1$-G-Bn-G-G | 1.4E-09 | 153 |
| 2573-20_348 | G-G-C$^1$-A-G-G$^1$-Bn-Bn-U$^1$-G-G-Nap-A-Bn-Bn-A$^1$-A-C-A$^1$-C$^1$-G-Bn-Bn-A$^1$-A-G$^1$-U$^1$-C3-G-Bn-G-G | 6.1E-09 | 154 |
| 2573-20_351 | G-G-C$^1$-A-G-G$^1$-Bn-Bn-U$^1$-G-G-Nap-A-Bn-Bn-A$^1$-A-C-A$^1$-C$^1$-G-Bn-Bn-A$^1$-A-G$^1$-U$^1$-C3-G-Bn-G-G$^1$ | 2.4E-09 | 155 |
| 2573-20_354 | G-G-C$^1$-A-G-G$^1$-Bn-Bn-U$^1$-G-G-Nap-A-Bn-Bn-A$^1$-A$^1$-C-A$^1$-C$^1$-G-Bn-Bn-A$^1$-A-G$^1$-U$^1$-C3-G-Bn-G-G | 2.4E-09 | 156 |
| 2573-20_355 | G-G-C$^1$-A-G-G$^1$-Bn-Bn-U$^1$-G-G-Nap-A-Bn-Bn-A$^1$-A$^1$-C-A$^1$-C$^1$-G-Bn-Bn-A$^1$-A$^1$-G-U$^1$-C3-G-Bn-G-G | 3.7E-09 | 157 |
| 2573-20_359 | G-G-C$^1$-A-G-G$^1$-Bn-Bn-Pe-G-G-Nap-A-Bn-Bn-A$^1$-A-Heg-Bn-Bn-A$^1$-A-G-Bn-C$^1$-G-Bn-G-G | 1.4E-09 | 158 |
| 2573-20_362 | G-G-C$^1$-A-G-G$^1$-Bn-Bn-Pe-G-G-Nap-A-Bn-Bn-A$^1$-A-Heg-Tyr-Tyr-A$^1$-A-G-U$^1$-C$^1$-G-Bn-G-G | 5.7E-10 | 159 |
| 2573-20_363 | G-G-C$^1$-A-G-G$^1$-Bn-Bn-Pe-G-G-Nap-A-Bn-Bn-A$^1$-A-Heg-Tyr-Bn-A$^1$-A-G-U$^1$-C3-G-Bn-G-G | 6.9E-10 | 160 |
| 2573-20_364 | G-G-C$^1$-A-G-G$^1$-Bn-Bn-Pe-G-G-Nap-A-Bn-Bn-A$^1$-A-Heg-Tyr-Bn-A$^1$-A-G-U$^1$-C3-G-Tyr-G-G | 8.0E-10 | 161 |
| 2573-20_365 | G-G-C$^1$-A-G-G$^1$-Bn-Bn-Pe-G-G-Nap-A-Bn-Bn-A$^1$-A$^1$-Heg-Tyr-Bn-A$^1$-A-G$^1$-U$^1$-C$^1$-G-Bn-G-G$^1$ | 7.8E-11 | 162 |
| 2573-20_366 | G-G-C$^1$-A-G-G$^1$-Bn-Bn-Pe-G-G-Nap-A-Bn-Bn-A$^1$-A$^1$-Heg-Tyr-Bn-A$^1$-A-G$^1$-U$^1$-C$^1$-G-Tyr-G-G$^1$ | 1.8E-10 | 163 |
| 2573-20_367 | G-G-C$^1$-A-G-G$^1$-Bn-Bn-Pe-G-G-Nap-A-Bn-Bn-A$^1$-A$^1$-Heg-Tyr-Tyr-A$^1$-A-G$^1$-U$^1$-C$^1$-G-Bn-G-G$^1$ | 9.0E-11 | 164 |
| 2573-20_368 | G-G-C$^1$-A-G-G$^1$-Bn-Bn-Pe-G-G-Nap-A-Bn-Tyr-A$^1$-A$^1$-Heg-Tyr-Bn-A$^1$-A-G$^1$-U$^1$-C$^1$-G-Tyr-G-G$^1$ | 2.9E-10 | 165 |
| 2573-20_369 | G-G-C$^1$-A-G-G$^1$-Bn-Bn-Pe-G-G-Nap-A-Bn-Bn-A$^1$-A$^1$-Heg-Tyr-Bn-A$^1$-A$^0$-G$^1$-U$^1$-C$^1$-G-Bn-G-G$^1$ | 3.1E-10 | 166 |
| 2573-20_370 | G-G-C$^1$-A-G-G$^1$-Bn-Bn-Pe-G-G-Nap-A-Bn-Tyr-A$^1$-A$^1$-Heg-Tyr-Bn-A$^1$-A$^0$-G$^1$-U$^1$-C$^1$-G-Tyr-G-G$^1$ | 9.0E-09 | 167 |
| 2573-20_375 | G-G-C$^1$-A-G-G$^1$-Bn-Bn-U1-G-G-Nap-A-Bn-Bn-A$^1$-A-C-A$^1$-C$^1$-G-Tyr-Bn-A$^1$-A-G-U$^1$-C3-G-Bn-G-G | 7.0E-09 | 168 |
| 2573-20_376 | G-G-C$^1$-A-G-G$^1$-Bn-Bn-U$^1$-G-G-Nap-A-Bn-Bn-A$^1$-A-C-A$^1$-C$^1$-G-Tyr-Bn-A$^1$-A-G-U$^1$-C3-G-Tyr-G-G | 4.4E-09 | 169 |
| 2573-20_377 | G-G-C$^1$-A-G-G$^1$-Bn-Bn-U$^1$-G-G-Nap-A-Bn-Bn-A$^1$-A$^1$-C-A$^1$-C$^1$-G-Bn-Bn-A$^1$-A-G$^1$-U$^1$-C3-G-Bn-G-G$^1$ | 1.8E-10 | 170 |
| 2573-20_378 | G-G-C$^1$-A-G-G$^1$-Bn-Bn-U$^1$-G-G-Nap-A-Bn-Bn-A$^1$-A$^1$-C-A$^1$-C$^1$-G-Tyr-Bn-A$^1$-A-G$^1$-U$^1$-C3-G-Bn-G-G$^1$ | 7.6E-10 | 171 |

TABLE 10-continued

Variants of 2573-20 136 (SEQ ID NO: 101) with IC$_{50}$ ranging from $10^{-11}$ M to $10^{-8}$ M.

| Aptamer | Sequence | IC$_{50}$ (M) | SEQ ID NO |
|---|---|---|---|
| 2573-20_379 | G-G-C$^1$-A-G-G$^1$-Bn-Bn-U$^1$-G-G-Nap-A-Bn-Bn-A$^1$-A$^1$-C-A$^1$-C$^1$-G-Bn-Tyr-A$^1$-A-G$^1$-U$^1$-C3-G-Bn-G-G$^1$ | 5.2E-10 | 172 |
| 2573-20_380 | G-G-C$^1$-A-G-G$^1$-Bn-Bn-U$^1$-G-G-Nap-A-Bn-Bn-A$^1$-A$^1$-C-A$^1$-C$^1$-G-Tyr-Tyr-A$^1$-A-G$^1$-U$^1$-C3-G-Bn-G-G$^1$ | 1.9E-10 | 173 |
| 2573-20_381 | G-G-C$^1$-A-G-G$^1$-Bn-Bn-U$^1$-G-G-Nap-A-Bn-Tyr-A$^1$-A$^1$-C-A$^1$-C$^1$-G-Tyr-Bn-A$^1$-A-G$^1$-U$^1$-C3-G-Tyr-G-G$^1$ | 2.2E-09 | 174 |
| 2573-20_382 | G-G-C$^1$-A-G-G$^1$-Bn-Bn-U$^1$-G-G-Nap-A-Bn-Bn-A$^1$-A$^1$-C-A$^1$-C$^1$-G-Bn-Bn-A$^1$-A$^0$-G$^1$-U$^1$-C3-G-Bn-G-G$^1$ | 1.3E-09 | 175 |
| 2573-20_386 | G-G-C$^1$-A-G-G$^1$-Bn-Bn-Pe-G-G-Nap-A-Bn-Bn-A$^1$-A-C$^1$-Heg-G$^1$-Tyr-Bn-A$^1$-A-G-U$^1$-C$^1$-G-Bn-G-G | 3.9E-10 | 176 |
| 2573-20_387 | G-G-C$^1$-A-G-G$^1$-Bn-Bn-Pe-G-G-Nap-A-Bn-Bn-A$^1$-A-C$^1$-Heg-G-Bn-Bn-A$^1$-A-G-U$^1$-C$^1$-G-Bn-G-G | 3.3E-10 | 177 |
| 2573-20_388 | G-G-C$^1$-A-G-G$^1$-Bn-Bn-Pe-G-G-Nap-A-Bn-Bn-A$^1$-A-C-Heg-G$^1$-Bn-Bn-A$^1$-A-G-U$^1$-C$^1$-G-Bn-G-G | 7.1E-10 | 178 |
| 2573-20_389 | G-G-C$^1$-A-G-G$^1$-Bn-Bn-Pe-G-G-Nap-A-Bn-Bn-A$^1$-A-C$^1$-Heg-G$^1$-Bn-Bn-A$^1$-A-G-U$^1$-C$^1$-G-Bn-G-G | 5.6E-11 | 179 |
| 2573-20_390 | G-G-C$^1$-A-G-G$^1$-Bn-Bn-Pe-G-G-Nap-A-Bn-Bn-A$^1$-A$^1$-C$^1$-Heg-G$^1$-Bn-Bn-A$^1$-A-G$^1$-U$^1$-C$^1$-G-Bn-G-G$^1$ | 2.6E-10 | 180 |
| 2573-20_391 | G-G-C$^1$-A-G-G$^1$-Bn-Bn-Pe-G-G-Nap-A-Bn-Bn-A$^1$-A$^1$-C$^1$-Heg-G$^1$-Bn-Bn-A$^1$-A$^0$-G$^1$-U$^1$-C$^1$-G-Bn-G-G1 | 2.8E-10 | 181 |
| 2573-20_392 | G-G-C$^1$-A-G-G$^1$-Bn-Bn-U$^1$-G-G-Nap-A-Bn-Bn-A$^1$-A-C$^1$-Heg-G-Tyr-Bn-A$^1$-A-G-U$^1$-C$^1$-G-Bn-G-G | 8.6E-10 | 182 |
| 2573-20_393 | G-G-C$^1$-A-G-G$^1$-Bn-Bn-U$^1$-G-G-Nap-A-Bn-Bn-A$^1$-A-C-Heg-G$^1$-Tyr-Bn-A$^1$-A-G-U$^1$-C$^1$-G-Bn-G-G | 1.9E-09 | 183 |
| 2573-20_394 | G-G-C$^1$-A-G-G$^1$-Bn-Bn-U$^1$-G-G-Nap-A-Bn-Bn-A$^1$-A-C$^1$-Heg-G$^1$-Tyr-Bn-A$^1$-A-G-U$^1$-C$^1$-G-Bn-G-G | 2.1E-10 | 184 |
| 2573-20_395 | G-G-C$^1$-A-G-G$^1$-Bn-Bn-U$^1$-G-G-Nap-A-Bn-Bn-A$^1$-A$^1$-C$^1$-Heg-G$^1$-Tyr-Bn-A$^1$-A-G$^1$-U$^1$-C$^1$-G-Bn-G-G$^1$ | 8.6E-11 | 185 |
| 2573-20_396 | G-G-C$^1$-A-G-G$^1$-Bn-Bn-U$^1$-G-G-Nap-A-Bn-Bn-A$^1$-A$^1$-C$^1$-Heg-G$^1$-Tyr-Bn-A$^1$-A$^0$-G$^1$-U$^1$-C$^1$-G-Bn-G-G$^1$ | 4.7E-11 | 186 |
| 2573-20_399 | G-G-C$^1$-A-G-G$^1$-Bn-Bn-Pe-G-G-Nap-A-Bn-Bn-A$^1$-A$^0$-C-A$^1$-C$^1$-G-Bn-Bn-A$^1$-A$^0$-G$^1$-U$^1$-C$^1$-G-Bn-G-G$^1$ | 3.3E-09 | 187 |
| 2573-20_407 | G-G-C$^1$-A-G-G$^1$-Bn-Bn-Pe-G-G-Nap-A-Bn-Bn-A$^1$-A$^0$-C-Heg-G-Bn-Bn-A$^1$-A$^0$-G$^1$-U$^1$-C$^1$-G-Bn-G-G$^1$ | 2.4E-10 | 188 |
| 2573-20_408 | G-G-C$^1$-A-G-G$^1$-Bn-Bn-Pe-G-G-Nap-A-Bn-Bn-A$^1$-A-C$^1$-Heg-G$^0$-Bn-Bn-A$^1$-A-G-U$^1$-C$^1$-G-Bn-G-G | 7.2E-10 | 189 |
| 2573-20_409 | G-G-C$^1$-A$^1$-G-G$^1$-Bn-Bn-Pe-G-G-Nap-A-Bn-Bn-A$^1$-A$^1$-C$^1$-Heg-G$^1$-Bn-Bn-A$^1$-A-G$^1$-U$^1$-C$^1$-G-Bn-G-G$^1$ | 3.2E-09 | 190 |
| 2573-20_410 | G-G-C$^1$-A$^1$-G-G$^1$-Bn-Bn-Pe-G-G-Nap-A-Bn-Bn-A$^1$-A$^1$-C$^1$-Heg-G$^1$-Tyr-Bn-A$^1$-A$^1$-G$^1$-U$^1$-C$^1$-G-Bn-G-G$^1$ | 9.8E-10 | 191 |
| 2573-20_452 | G-G-C$^1$-A-G-G$^1$-Bn-Bn-Pe-G-G-Nap-A-Bn-Bn-A$^1$-A-Heg-Tyr-Bn-A$^1$-A-G-U$^1$-C$^1$-G$^2$-Bn-G-G | 4.1E-10 | 192 |
| 2573-20_455 | G-G-C$^1$-A-G-G$^1$-Bn-Bn-Pe-G-G-Nap-A-Bn-Bn-A$^1$-A-Heg-Tyr-Bn-A$^1$-A-G-U$^1$-C$^1$-G-Bn-G-G$^2$ | 2.6E-10 | 193 |
| 2573-20_478 | G-G-C$^1$-A-G-G$^1$-Bn-Bn-Pe-G-G-Nap-A-Bn-Bn-A$^1$-A-Heg-Tyr-Bn-A$^1$-A-G-U$^1$-C$^1$-G-Bn$^2$-G-G | 7.4E-11 | 194 |
| 2573-20_489 | G-G-C$^1$-A-G-G$^1$-Bn-Bn-Bn$^1$-G-G-Nap-A-Bn-Bn-A$^1$-A-C$^1$-A$^1$-C$^1$-G-Bn-Bn-A$^1$-A-G-Bn-C$^1$-G-Bn-G-G | 3.6E-09 | 195 |

TABLE 10-continued

Variants of 2573-20 136 (SEQ ID NO: 101) with IC$_{50}$ ranging from $10^{-11}$ M to $10^{-8}$ M.

| Aptamer | Sequence | IC$_{50}$ (M) | SEQ ID NO |
|---|---|---|---|
| 2573-20_625 | G-G-C$^1$-A$^1$-G-G$^1$-Bn-Bn-Pe-G-G-Nap-A-Bn-Bn$^1$-A$^1$-A$^1$-Heg-Bn$^1$-Bn$^1$-A$^1$-A$^1$-G$^1$-U$^1$-C$^1$-G-Bn-G-G$^1$ | 1.2E-09 | 196 |
| 2573-20_626 | G-G-C$^1$-A$^1$-G-G$^1$-Bn$^1$-Bn-Pe-G-G-Nap-A-Bn-Bn$^1$-A$^1$-A$^1$-Heg-Bn$^1$-Bn$^1$-A$^1$-A$^1$-G$^1$-U$^1$-C$^1$-G-Bn-G-G$^1$ | 3.7E-09 | 197 |
| 2573-20_627 | G-G-C$1$-A$^1$-G-G$^1$-Bn$^1$-Bn-Pe-G-G-Nap-A-Bn-Bn$^1$-A$^1$-A$^1$-Heg-Bn-Bn$^1$-A$^1$-A$^1$-G$^1$-U$^1$-C$^1$-G-Bn-G-G$^1$ | 1.3E-09 | 198 |
| 2573-20_628 | G-G-C$^1$-A$^1$-G-G$^1$-Bn$^1$-Bn-Pe-G-G-Nap-A-Bn-Bn$^1$-A$^1$-A$^1$-Heg-Bn-Bn-A$^1$-A$^1$-G$^1$-U$^1$-C$^1$-G-Bn-G-G$^1$ | 4.1E-09 | 199 |
| 2573-20_629 | G-G-C$^1$-A$^1$-G-G$^1$-Bn$^1$-Bn-Pe-G-G-Nap-A-Bn-Bn$^1$-A$^1$-A$^1$-Heg-Bn$^1$-Bn$^1$-A$^1$-A$^1$-G$^1$-U$^1$-C$^1$-G-Bn-G-G$^1$ | 1.5E-09 | 200 |
| 2573-20_630 | G-G-C$^1$-A$^1$-G-G$^1$-Bn$^1$-Bn-Bn$^1$-G-G-Nap-A-Bn-Bn$^1$-A$^1$-A$^1$-Heg-Bn$^1$-Bn$^1$-A$^1$-A$^1$-G$^1$-U$^1$-C$^1$-G-Bn-G-G$^1$ | 1.4E-09 | 201 |
| 2573-20_633 | G$^2$-G$^2$-C$^1$-A$^1$-G$^2$-G$^1$-Bn$^2$-Bn$^2$-Bn$^2$-G-G$^2$-Nap$^2$-A$^2$-Bn$^2$-Bn$^2$-A$^1$-A$^1$-Heg$^2$-Bn$^2$-Bn$^1$-A$^1$-A$^1$-G$^1$-U$^1$-C$^1$-G$^2$-Bn$^2$-G$^2$-G$^1$ | 3.0E-09 | 202 |
| 2573-20_634 | G$^2$-G$^2$-C$^1$-A$^1$-G$^2$-G$^1$-Bn$^2$-Bn$^2$-Bn$^2$-G$^2$-G$^2$-Nap$^2$-A$^2$-Bn$^2$-Bn$^2$-A$^1$-A$^1$-Heg$^2$-Bn$^2$-Bn$^1$-A$^1$-A$^1$-G$^1$-U$^1$-C$^1$-G$^2$-Bn$^2$-G$^2$-G$^1$ | 3.8E-09 | 203 |
| 2573-20_635 | G-G-C$^1$-A$^1$-G-G$^1$-Bn-Bn-Pe-G-G-Nap-A-Bn-Bn$^1$-A$^1$-A$^1$-C$^1$-Heg-G$^1$-Bn$^1$-Bn$^1$-A$^1$-A$^1$-G$^1$-U$^1$-C$^1$-G-Bn-G-G$^1$ | 5.4E-10 | 204 |
| 2573-20_636 | G-G-C$^1$-A$^1$-G-G$^1$-Bn-Bn-Pe-G-G-Nap-A-Bn-Bn$^1$-A$^1$-A$^1$-C$^1$-Heg-G$^1$-Bn$^1$-Bn$^1$-A$^1$-A$^1$-G$^1$-U$^1$-C$^1$-G-Bn-G-G$^1$ | 7.0E-09 | 205 |
| 2573-20_637 | G-G-C$^1$-A$^1$-G-G$^1$-Bn-Bn-Pe-G-G-Nap-A-Bn-Bn$^1$-A$^1$-A$^1$-C$^1$-Heg-G$^1$-Bn-Bn$^1$-A$^1$-A$^1$-G$^1$-U$^1$-C$^1$-G-Bn-G-G$^1$ | 9.0E-10 | 206 |
| 2573-20_638 | G-G-C$^1$-A$^1$-G-G$^1$-Bn-Bn-Pe-G-G-Nap-A-Bn-Bn$^1$-A$^1$-A$^1$-C$^1$-Heg-G$^1$-Bn$^1$-Bn-A$^1$-A$^1$-G$^1$-U$^1$-C$^1$-G-Bn-G-G$^1$ | 6.6E-10 | 207 |
| 2573-20_639 | G-G-C$^1$-A$^1$-G-G$^1$-Bn$^1$-Bn-Pe-G-G-Nap-A-Bn-Bn$^1$-A$^1$-A$^1$-C$^1$-Heg-G$^1$-Bn$^1$-Bn$^1$-A$^1$-A$^1$-G$^1$-U$^1$-C$^1$-G-Bn-G-G$^1$ | 1.3E-09 | 208 |
| 2573-20_640 | G-G-C$^1$-A$^1$-G-G$^1$-Bn$^1$-Bn-Bn$^1$-G-G-Nap-A-Bn-Bn$^1$-A$^1$-A$^1$-C$^1$-Heg-G$^1$-Bn$^1$-Bn$^1$-A$^1$-A$^1$-G$^1$-U$^1$-C$^1$-G-Bn-G-G$^1$ | 2.9E-09 | 209 |
| 2573-20_643 | G$^2$-G$^2$-C$^1$-A$^1$-G$^2$-G$^1$-Bn$^2$-Bn$^2$-Bn$^2$-G-G$^2$-Nap$^2$-A$^2$-Bn$^2$-Bn$^2$-A$^1$-A$^1$-C$^1$-Heg$^2$-G$^1$-Bn$^2$-Bn$^1$-A$^1$-A$^1$-G$^1$-U$^1$-C$^1$-G$^2$-Bn$^2$-G$^2$-G$^1$ | 1.7E-09 | 210 |
| 2573-20_644 | G$^2$-G$^2$-C$^1$-A$^1$-G$^2$-G$^1$-Bn$^2$-Bn$^2$-Bn$^2$-G$^2$-G$^2$-Nap$^2$-A$^2$-Bn$^2$-Bn$^2$-A$^1$-A$^1$-C$^1$-Heg$^2$-G$^1$-Bn$^2$-Bn$^1$-A$^1$-A$^1$-G$^1$-U$^1$-C$^1$-G$^2$-Bn$^2$-G$^2$-G$^1$ | 1.2E-09 | 211 |
| 2573-20_700 | G-G-C$^1$-A$^1$-G-G$^1$-Bn$^1$-Bn-Bn$^1$-G-G-Nap-A-Bn-Bn$^1$-A$^1$-A$^1$-C$^1$-Heg-G$^1$-U$^1$-Bn$^1$-A$^1$-A$^1$-G$^1$-U$^1$-C$^1$-G-Bn-G-G$^1$ | 1.0E-08 | 212 |
| 2573-20_702 | G-G-C$^1$-A$^1$-G-G$^1$-Bn-Bn-U$^1$-G-G-Nap-A-Bn-Bn$^1$-A$^1$-A$^1$-C$^1$-Heg-G$^1$-Bn-Bn-A$^1$-A$^1$-G$^1$-U$^1$-C$^1$-G-Bn-G-G$^1$ | 6.8E-09 | 213 |
| 2573-20_711 | G-G-C$^1$-A$^1$-G-G$^1$-Bn-Bn-U$^1$-G-G-Nap-A-Bn-Bn$^1$-A$^1$-A$^1$-C$^1$-Heg-G$^1$-Bn-Bn-A$^1$-A$^1$-G$^1$-U$^1$-C$^1$-G-Bn$^2$-G$^2$-G$^1$ | 6.5E-09 | 214 |
| 2573-20_719 | G-G-C$^1$-A$^1$-G-G$^1$-M Bn-Bn-Pe-G-G-Nap-A-Bn-Bn$^1$-A$^1$-A$^1$-C$^1$-Heg-G$^1$-Bn-Bn-A$^1$-A$^1$-G$^1$-Bn-C$^1$-G-Bn-G-G$^1$ | 6.1E-10 | 215 |
| 2573-20_720 | G-G-C$^1$-A$^1$-G-G$^1$-Bn-Bn-Pe-G-G-Nap-A-Bn-Bn$^1$-A$^1$-A$^1$-C$^1$-Heg-G$^1$-Bn-Bn-A$^1$-A$^1$-G$^1$-Bn-C$^1$-G-Ib-G-G$^1$ | 1.2E-09 | 216 |
| 2573-20_722 | G-G-C$^1$-A$^1$-G-G$^1$-MBn-Bn-Pe-G-G-Nap-A-Bn-Bn$^1$-A$^1$-C$^1$-Heg-G$^1$-Bn-Bn-A$^1$-A$^1$-G$^1$-Bn-C$^1$-G-Ib-G-G$^1$ | 8.3E-09 | 217 |
| 2573-20_745 | G$^2$-G$^2$-C$^1$-A$^1$-G$^2$-G$^1$-Bn$^1$-Bn$^2$-U$^1$-G$^2$-G$^2$-Nap$^2$-A$^2$-Bn$^2$-Bn$^1$-A$^1$-A$^1$-C$^1$-Heg$^1$-G$^1$-Bn$^1$-Bn$^1$-A$^1$-A$^1$-G$^1$-U$^1$-C$^1$-G$^2$-Bn$^2$-G$^2$-G$^1$ | 4.3E-09 | 218 |

TABLE 10-continued

Variants of 2573-20 136 (SEQ ID NO: 101) with IC$_{50}$ ranging from $10^{-11}$ M to $10^{-8}$ M.

| Aptamer | Sequence | IC$_{50}$ (M) | SEQ ID NO |
|---|---|---|---|
| 2573-20_746 | G-G-C$^1$-A$^1$-G-G$^1$-Bn$^1$-Bn$^2$-U$^1$-G-G-Nap-A-Bn$^2$-Bn$^1$-A$^1$-A$^1$-C$^1$-Heg-G$^1$-Bn$^1$-Bn$^1$-A$^1$-A$^1$-G$^1$-U$^1$-C$^1$-G$^2$-Bn$^2$-G$^2$-G$^1$ | 9.8E-10 | 219 |
| 2573-20_771 | G-G-C$^1$-A-G-G$^1$-Bn-Bn-U$^1$-G-G-Nap-A-Bn-Bn-A$^1$-A$^1$-C$^1$-Heg-G$^1$-Bn-Bn-A$^1$-A$^1$-G$^1$-U$^1$-C$^1$-G-Bn-G-G$^1$ | 2.2E-10 | 220 |
| 2573-20_772 | G-G-C$^1$-A-G-G$^1$-MBn-Bn-U$^1$-G-G-Nap-A-Bn-Bn-A$^1$-A$^1$-C$^1$-Heg-G$^1$-Bn-Bn-A$^1$-A$^1$-G$^1$-U$^1$-C$^1$-G-Bn-G-G$^1$ | 5.7E-11 | 221 |
| 2573-20_773 | G-G-C$^1$-A-G-G$^1$-MBn-Bn-U$^1$-G-G-Nap-A-Bn-Bn-A$^1$-A$^1$-C$^1$-Heg-G$^1$-Bn-Bn-A$^1$-A$^1$-G$^1$-U$^1$-C$^1$-G$^2$-Bn$^2$-G$^2$-G$^1$ | 1.1E-10 | 222 |
| 2573-20_779 | G-G-C$^1$-A-G-G$^1$-Bn-Bn$^2$-U$^1$-G-G-Nap-A-Bn-Bn$^1$-A$^1$-A-C-A$^1$-C$^1$-G-Bn-Bn$^1$-A$^1$-A-G-Bn-C$^1$-G$^2$-Bn$^2$-G$^2$-G$^1$ | 6.3E-11 | 223 |
| 2573-20_780 | G-G-C$^1$-A-G-G$^1$-Bn-Bn-Pe$^2$-G-G-Nap-A-Bn-Bn-A$^1$-A-C-A$^1$-C$^1$-G-Bn-Bn$^2$-A-A-G-Bn-C$^1$-G-Bn$^2$-G-G | 8.7E-11 | 224 |
| 2573-20_802 | G-G-C$^1$-A-G-G$^1$-MBn-Bn-U$^1$-G-G-Nap-A-Bn-Bn-A$^1$-A$^1$-C$^1$-Heg-G$^1$-Bn-Bn-A$^1$-A$^1$-G$^1$-U$^1$-C$^1$-G-Bn$^2$-G-G$^1$ | 1.6E-10 | 225 |
| 2573-20_803 | G-G-C$^1$-A-G-G$^1$-MBn-Bn-U$^1$-G-G-Nap-A-Bn-Bn$^1$-A$^1$-A$^1$-C$^1$-Heg-G$^1$-Bn-Bn-A$^1$-A$^1$-G$^1$-U$^1$-C$^1$-G-Bn$^2$-G-G$^1$ | 2.6E-10 | 226 |
| 2573-20_804 | G-G-C$^1$-A-G-G$^1$-MBn-Bn-U$^1$-G-G-Nap-A-Bn$^2$-Bn$^1$-A$^1$-A$^1$-C$^1$-Heg-G$^1$-Bn-Bn-A$^1$-A$^1$-G$^1$-U$^1$-C$^1$-G-Bn$^2$-G-G$^1$ | 1.1E-10 | 227 |
| 2573-20_806 | G-G-C$^1$-A-G-G$^1$-Bn-Bn-U$^1$-G-G-Nap-A-Bn-Bn-A$^1$-A-C-A$^1$-C$^1$-G-Bn-Bn-A$^1$-A-G-Bn-C$^1$-G-Bn$^2$-G-G | 6.3E-10 | 228 |
| 2573-20_807 | G-G-C$^1$-A-G-G$^1$-Bn-Bn-U$^1$-G-G-Nap-A-Bn-Bn$^1$-A$^1$-A-C-A$^1$-C$^1$-G-Bn-Bn-A$^1$-A-G-Bn-C$^1$-G-Bn$^2$-G-G | 1.2E-09 | 229 |
| 2573-20_808 | G-G-C$^1$-A-G-G$^1$-Bn-Bn-U$^1$-G-G-Nap-A-Bn$^2$-Bn$^1$-A$^1$-A-C-A$^1$-C$^1$-G-Bn-Bn-A$^1$-A-G-Bn-C$^1$-G-Bn$^2$-G-G | 2.7E-09 | 230 |
| 2573-20_809 | G-G-C$^1$-A-G-G$^1$-Bn-Bn-Pe$^2$-G-G-Nap-A-Bn-Bn-A$^1$-A-C-A$^1$-C$^1$-G-Bn-Bn$^2$-A-A-G-Bn-C$^1$-G$^2$-Bn$^2$-G$^2$-G | 1.8E-10 | 231 |
| 2573-20_834 | G-G-C$^1$-A$^1$-G-G$^1$-MBn$^1$-Bn$^2$-U$^1$-G-G-Nap-A-Bn$^2$-Tyr$^2$-A$^1$-A$^1$-C$^1$-Heg-G$^1$-Tyr$^2$-Tyr$^2$-A$^1$-A$^1$-G$^1$-U$^1$-C$^1$-G$^2$-Tyr$^2$-G$^2$-G$^1$ | 2.7E-11 | 232 |
| 2573-20_835 | G-G-C$^1$-A$^1$-G-G$^1$-MBn$^1$-Bn$^2$-U$^1$-G-G-Tyr-A-Bn$^2$-Tyr$^2$-A$^1$-A$^1$-C$^1$-Heg-G$^1$-Tyr$^2$-Tyr$^2$-A$^1$-A$^1$-G$^1$-U$^1$-C$^1$-G$^2$-Tyr$^2$-G$^2$-G$^1$ | 1.1E-10 | 233 |
| 2573-20_836 | G-G-C$^1$-A$^1$-G-G$^1$-MBn$^1$-Bn$^2$-U$^1$-G-G-Tyr-A-Nap$^2$-Tyr$^2$-A$^1$-A$^1$-C$^1$-Heg-G$^1$-Tyr$^2$-Tyr$^2$-A$^1$-A$^1$-G$^1$-U$^1$-C$^1$-G$^2$-Tyr$^2$-G$^2$-G$^1$ | 4.2E-10 | 234 |
| 2573-20_837 | G-G-C$^1$-A$^1$-G-G$^1$-MBn$^1$-Bn$^2$-U$^1$-G-G-Nap-A-Nap$^2$-Tyr$^2$-A$^1$-A$^1$-C$^1$-Heg-G$^1$-Tyr$^2$-Tyr$^2$-A$^1$-A$^1$-G$^1$-U$^1$-C$^1$-G$^2$-Tyr$^2$-G$^2$-G$^1$ | 6.9E-11 | 235 |
| 2573-20_838 | G-G-C$^1$-A$^1$-G-G$^1$-MBn$^1$-Bn$^2$-U$^1$-G-G-Nap-A-Bn$^2$-Tyr$^2$-A$^1$-A$^1$-C$^1$-Heg-G$^1$-Tyr$^2$-Tyr$^2$-A$^1$-A$^1$-G$^1$-U$^1$-C$^1$-G-Tyr$^2$-G-G$^1$ | 4.8E-11 | 236 |
| 2573-20_898 | G-G-C$^1$-A$^1$-G-G$^1$-MBn$^1$-Bn$^2$-U$^1$-G-G-Nap$^2$-A$^2$-Bn$^2$-Bn$^1$-A$^1$-A$^1$-C$^1$-Heg-G$^1$-Bn$^1$-Bn$^1$-A$^1$-A$^1$-G$^1$-U$^1$-C$^1$-G$^2$-Bn$^2$-G$^2$-G$^1$ | 1.6E-10 | 237 |
| 2573-20_899 | G-G-C$^1$-A$^1$-G-G$^1$-MBn$^1$-Bn$^2$-U$^1$-G-G-Nap$^2$-A$^2$-Bn$^2$-MOE$^1$-A$^1$-A$^1$-C$^1$-Heg-G$^1$-MOE$^1$-MOE$^1$-A$^1$-A$^1$-G$^1$-U$^1$-C$^1$-G$^2$-MOE$^2$-G$^2$-G$^1$ | 3.3E-09 | 238 |

TABLE 10-continued

Variants of 2573-20 136 (SEQ ID NO: 101) with IC$_{50}$ ranging from $10^{-11}$ M to $10^{-8}$ M.

| Aptamer | Sequence | IC$_{50}$ (M) | SEQ ID NO |
|---|---|---|---|
| 2573-20_901 | G-G-C$^1$-A$^2$-G-G$^1$-MBn$^1$-Bn$^2$-MOE$^1$-G-G-Nap$^2$-A$^2$-Bn$^2$-MOE$^1$-A$^1$-A$^1$-C$^1$-Heg-G$^1$-MOE$^1$-MOE$^1$-A$^1$-A$^1$-G$^1$-U$^1$-C$^1$-G$^2$-MOE$^2$-G$^2$-G$^1$ | 3.1E-09 | 239 |

No-superscript-indicates-deoxyribose
Superscript-o-indicates-2'-fluoro
Superscript-1-indicates-2'-O-methyl
Superscript-2-indicates-phosphorothioate-(deoxyribose)
C3 = -three-carbon-linker
Heg = -hexaethylene-glycol-linker
Na = -naphthyl-dU
Pe = -phenethyl-dU
BT = -benzothiophenyl-dU
Ib = -isobutyl-dU
2Nap = -2-naphthyl-dU
NE = -naphthylethyl-dU
MBn = -methylenedioxybenzyl-dU
Tyr = -tyrosyl-dU
FBn = -fluorobenzyl-dU
Bn = -benzyl-dU
Trp = -tryptaminyl-dU
Th = -thiophenyl-dU
2NE = -2-naphthylethyl-dU
PP = -phenpropyl-dU
Im = imidazolyl-dU
Thr = threoninyl-dU
CHM = cycohexylmethyl-dU
Pyr = pyridyl-dU
RTM = R-tetrahydrofuranyl-dU
MOE = morpholinoethyl

TABLE 11

Variants of 2573-20 136 (SEQ ID NO: 101) with IC$_{50}$ greater than $10^{-8}$ M.

| Aptamer | Sequence | IC$_{50}$ (M) | SEQ ID NO |
|---|---|---|---|
| 2573-20_116 | - G-G-C-A-G-G-T-T-G-G-T-A-T-T-A-A-C-A-C-G-T-T-A-A-G-T-C-G-T-G-G | >1.0E-06 | 300 |
| 2573-20_262 | G-G-C$^1$-A-G-G$^1$-Bn-Bn-Pe-G-G-Nap-A-U$^1$-Bn-A$^1$-A-C-A$^1$-C$^1$-G-Bn-Bn-A-A-G-Bn-C$^1$-G-Bn-G-G | >1.0E-06 | 301 |
| 2573-20_267 | G-G-C$^1$-A-G-G$^1$-Bn-Bn-Pe-G-G-Nap-A-Bn-Bn-A$^1$-A-C-A$^1$-C$^1$-G-Bn-Bn-A-A-G-Bn-C$^1$-G-U$^1$-G-G | 4.0E-08 | 302 |
| 2573-20_269 | G-G-C$^1$-A-G-G$^1$-Bn-Bn-U$^1$-G-G-Nap-A-Bn-Bn-A$^1$-A-Heg-Bn-Bn-A$^1$-A-G-Bn-C$^1$-G-Bn-G-G | 5.1E-08 | 303 |
| 2573-20_270 | G-G-C$^1$-A-G-G$^1$-Bn-Bn-U$^1$-G-G-Nap-A-Bn-Bn-A$^1$-A-Heg-Bn-Bn-A$^1$-A-G-U$^1$-C$^1$-G-Bn-G-G | 6.8E-08 | 304 |
| 2573-20_271 | G-G-C$^1$-A-G-G$^1$-Bn-Bn-U$^1$-G-G-Nap-A-Bn-Bn-A$^1$-A-Heg-Tyr-Bn-A$^1$-A-G-Bn-C$^1$-G-Bn-G-G | 3.6E-08 | 305 |
| 2573-20_272 | G-G-C$^1$-A-G-G$^1$-Bn-Bn-U$^1$-G-G-Nap-A-Bn-Bn-A$^1$-A-Heg-Bn-Tyr-A$^1$-A-G-Bn-C$^1$-G-Bn-G-G | 3.6E-08 | 306 |
| 2573-20_275 | G-G-C$^1$-A-G-G$^1$-Bn-Bn-U$^1$-G-G-Nap-A-Bn-Bn-A$^1$-A-Heg-Tyr-Bn-A$^1$-A-G-U$^1$-C$^1$-G-Bn-G-G | 1.7E-08 | 307 |
| 2573-20_276 | G-G-C$^1$-A-G-G$^1$-Bn-Bn-U$^1$-G-G-Nap-A-Bn-Bn-A$^1$-A-Heg-Bn-Tyr-A$^1$-A-G-U$^1$-C$^1$-G-Bn-G-G | 5.8E-08 | 308 |
| 2573-20_277 | G-G-C$^1$-A-G-G$^1$-Bn-Bn-U$^1$-G-G-Nap-A-Bn-Bn-A$^1$-A-Heg-FBn-Bn-A$^1$-A-G-Bn-C$^1$-G-Bn-G-G | >1.0E-06 | 309 |

TABLE 11-continued

Variants of 2573-20_136 (SEQ ID NO: 101) with $IC_{50}$ greater than $10^{-8}$ M.

| Aptamer | Sequence | $IC_{50}$ (M) | SEQ ID NO |
|---|---|---|---|
| 2573-20_279 | G-G-$C^1$-A-G-$G^1$-Bn-Bn-$U^1$-G-G-Nap-A-Bn-Bn-$A^1$-A-Heg-FBn-Bn-$A^1$-A-G-$U^1$-$C^1$-G-Bn-G-G | >1.0E-06 | 310 |
| 2573-20_281 | G-G-$C^1$-A-G-$G^1$-Bn-Bn-$U^1$-G-G-Nap-A-Bn-Bn-$A^1$-A-Heg-FBn-Tyr-$A^1$-A-G-$U^1$-$C^1$-G-Bn-G-G | >1.0E-06 | 311 |
| 2573-20_294 | G-G-$C^1$-A-G-$G^1$-Bn-Bn-$U^1$-G-G-Nap-A-Bn-Bn-$A^1$-A-Heg-Bn-Bn-$A^1$-A-G-$U^1$-C3-G-Bn-G-G | 6.7E-08 | 312 |
| 2573-20_295 | G-G-$C^1$-A-G-$G^1$-Bn-Bn-Pe-G-G-Nap-A-Bn-Bn-$A^1$-A-Heg-Bn-Bn-$A^1$-A-G-Heg-G-Bn-G-G | >1.0E-06 | 313 |
| 2573-20_296 | G-G-$C^1$-A-G-$G^1$-Bn-Bn-$U^1$-G-G-Nap-A-Bn-Bn-$A^1$-A-Heg-Bn-Bn-$A^1$-A-G-Heg-G-Bn-G-G | >1.0E-06 | 314 |
| 2573-20_298 | G-G-$C^1$-A-G-$G^1$-Bn-Bn-$U^1$-G-G-Nap-A-Bn-Bn-$A^1$-A-C-Heg-G-Bn-Bn-$A^1$-A-G-Heg-G-Bn-G-G | >1.0E-06 | 315 |
| 2573-20_302 | G-G-$C^1$-A-$G^0$-$G^1$-Bn-Bn-Pe-G-G-Nap-A-Bn-Bn-$A^1$-A-C-$A^1$-$C^1$-G-Bn-Bn-$A^1$-A-G-Bn-$C^1$-G-Bn-G-G | 2.3E-08 | 316 |
| 2573-20_303 | G-G-$C^1$-A-G-$G^1$-Bn-Bn-Pe-$G^0$-G-Nap-A-Bn-Bn-$A^1$-A-C-$A^1$-$C^1$-G-Bn-Bn-$A^1$-A-G-Bn-$C^1$-G-Bn-G-G | 1.6E-08 | 317 |
| 2573-20_308 | G-G-$C^1$-A-G-$G^1$-Bn-Bn-Pe-G-G-Nap-A-Bn-Bn-$A^1$-A-C-$A^1$-$C^1$-G-Bn-Bn-$A^1$-A-G-Bn-$C^1$-G-Bn-$G^0$-G | 1.9E-08 | 318 |
| 2573-20_324 | G-G-$C^1$-A-G-$G^1$-Bn-Bn-Pe-G-G-Nap-C3-G-Bn-G-G | 1.9E-07 | 319 |
| 2573-20_335 | G-G-$C^1$-A-G-$G^1$-Bn-Bn-Pe-G-G-Nap-A-Bn-Bn-$A^1$-A-Heg-Tyr-Bn-$A^1$-A-G-$U^1$-$C^1$-$G^1$-Bn-G-G | 5.1E-08 | 320 |
| 2573-20_338 | G-G-$C^1$-$A^1$-G-$G^1$-Bn-Bn-Pe-G-G-Nap-A-Bn-Bn-$A^1$-A-Heg-Tyr-Bn-$A^1$-A-G-$U^1$-$C^1$-G-Bn-G-G | 1.6E-08 | 321 |
| 2573-20_339 | G-G-$C^1$-A-G-$G^1$-Bn-Bn-Pe-G-G-Nap-$A^1$-Bn-Bn-$A^1$-A-Heg-Tyr-Bn-$A^1$-A-G-$U^1$-$C^1$-G-Bn-G-G | >1.0E-06 | 322 |
| 2573-20_342 | $G^1$-G-$C^1$-A-G-$G^1$-Bn-Bn-$U^1$-G-G-Nap-A-Bn-Bn-$A^1$-A-C-$A^1$-$C^1$-G-Bn-Bn-$A^1$-A-G-$U^1$-C3-G-Bn-G-G | 1.1E-08 | 323 |
| 2573-20_349 | G-G-$C^1$-A-G-$G^1$-Bn-Bn-$U^1$-G-G-Nap-A-Bn-Bn-$A^1$-A-C-$A^1$-$C^1$-G-Bn-Bn-$A^1$-A-G-$U^1$-C3-$G^1$-Bn-G-G | 6.2E-08 | 324 |
| 2573-20_352 | G-G-$C^1$-$A^1$-G-$G^1$-Bn-Bn-$U^1$-G-G-Nap-A-Bn-Bn-$A^1$-A-C-$A^1$-$C^1$-G-Bn-Bn-$A^1$-A-G-$U^1$-C3-G-Bn-G-G | 6.7E-08 | 325 |
| 2573-20_356 | G-G-$C^1$-A-G-$G^1$-Bn-Bn-$U^1$-G-G-Nap-A-Bn-Bn-$A^1$-A-$C^1$-$A^1$-$C^1$-G-Bn-Bn-$A^1$-A-G-$U^1$-C3-G-Bn-G-G | 1.1E-08 | 326 |
| 2573-20_361 | G-G-$C^1$-A-G-$G^1$-Bn-Bn-$U^1$-$G^1$-G-Nap-A-Bn-Bn-$A^1$-A-C-$A^1$-$C^1$-G-Bn-$U^1$-$A^1$-A-G-Bn-$C^1$-G-Bn-G-G | >1.0E-06 | 327 |
| 2573-20_383 | G-G-$C^1$-A-G-$G^1$-Bn-Bn-$U^1$-G-G-Nap-A-Bn-Tyr-$A^1$-$A^1$-C-$A^1$-$C^1$-G-Tyr-Bn-$A^1$-$A^0$-$G^1$-$U^1$-C3-G-Tyr-G-$G^1$ | >1.0E-06 | 328 |
| 2573-20_488 | G-G-$C^1$-A-G-$G^1$-Bn-Bn-$Bn^1$-$G^1$-G-Nap-A-Bn-Bn-$A^1$-A-C-$A^1$-$C^1$-G-Bn-$Bn^1$-$A^1$-A-G-Bn-$C^1$-G-Bn-G-G | 3.4E-08 | 329 |
| 2573-20_666 | G-G-$C^1$-A-G-$G^1$-Bn-Bn-$U^1$-G-G-Nap-A-Bn-Bn-$A^1$-$A^1$-$C^1$-Heg-$G^1$-$U^1$-Bn-$A^1$-$A^0$-$G^1$-$U^1$-$C^1$-G-Bn-G-$G^1$ | 8.3E-08 | 330 |
| 2573-20_669 | G-G-$C^1$-A-G-$G^1$-Bn-Bn-$U^1$-G-G-Nap-A-Bn-Bn-$A^1$-$A^1$-$C^1$-Heg-$G^1$-$U^1$-$U^1$-$A^1$-$A^0$-$G^1$-$U^1$-$C^1$-G-Bn-G-$G^1$ | 1.0E-06 | 331 |
| 2573-20_672 | G-G-$C^1$-A-G-$G^1$-Bn-Bn-$U^1$-G-G-Nap-A-Bn-Bn-$A^1$-$A^1$-$C^1$-Heg-$G^1$-$U^1$-Bn-$A^1$-$A^1$-$G^1$-$U^1$-$C^1$-G-Bn-G-$G^1$ | 1.3E-07 | 332 |
| 2573-20_675 | G-G-$C^1$-A-G-$G^1$-Bn-Bn-$U^1$-G-G-Nap-A-Bn-Bn-$A^1$-$A^1$-$C^1$-Heg-$G^1$-$U^1$-$U^1$-$A^1$-$A^1$-$G^1$-$U^1$-$C^1$-G-Bn-G-$G^1$ | 1.6E-07 | 333 |

TABLE 11-continued

Variants of 2573-20_136 (SEQ ID NO: 101) with $IC_{50}$ greater than $10^{-8}$ M.

| Aptamer | Sequence | $IC_{50}$ (M) | SEQ ID NO |
|---|---|---|---|
| 2573-20_697 | G-G-C$^1$-A$^1$-G-G$^1$-U$^1$-Bn-Bn$^1$-G-G-Nap-A-Bn-Bn$^1$-A$^1$-A$^1$-C$^1$-Heg-G$^1$-Bn$^1$-Bn$^1$-A$^1$-A$^1$-G$^1$-U$^1$-C$^1$-G-Bn-G-G$^1$ | 5.2E-07 | 334 |
| 2573-20_698 | G-G-C$^1$-A$^1$-G-G$^1$-Bn-Bn-Bn$^1$-G-G-U$^1$-A-Bn-Bn$^1$-A$^1$-A$^1$-C$^1$-Heg-G$^1$-Bn$^1$-Bn$^1$-A$^1$-A$^1$-G$^1$-U$^1$-C$^1$-G-Bn-G-G$^1$ | 1.1E-07 | 335 |
| 2573-20_699 | G-G-C$^1$-A$^1$-G-G$^1$-Bn-Bn-Bn$^1$-G-G-Nap-A-Bn-U$^1$-A$^1$-A$^1$-C$^1$-Heg-G$^1$-Bn$^1$-Bn$^1$-A$^1$-A$^1$-G$^1$-U$^1$-C$^1$-G-Bn-G-G$^1$ | 4.6E-08 | 336 |
| 2573-20_701 | G-G-C$^1$-A$^1$-G-G$^1$-Bn-Bn-Bn$^1$-G-G-Nap-A-Bn-Bn$^1$-A$^1$-A$^1$-C$^1$-Heg-G$^1$-Bn$^1$-U$^1$-A$^1$-A$^1$-G$^1$-U$^1$-C$^1$-G-Bn-G-G$^1$ | 1.4E-08 | 337 |
| 2573-20_703 | G-G-C$^1$-A$^1$-G-G$^1$-U$^1$-Bn-U$^1$-G-G-Nap-A-Bn-Bn-A$^1$-A$^1$-C$^1$-Heg-G$^1$-Bn-Bn-A$^1$-A$^1$-G$^1$-U$^1$-C$^1$-G-Bn-G-G$^1$ | 1.8E-07 | 338 |
| 2573-20_704 | G-G-C$^1$-A$^1$-G-G$^1$-Bn-Bn-U$^1$-G-G-U$^1$-A-Bn-Bn-A$^1$-A$^1$-C$^1$-Heg-G$^1$-Bn-Bn-A$^1$-A$^1$-G$^1$-U$^1$-C$^1$-G-Bn-G-G$^1$ | 2.9E-07 | 339 |
| 2573-20_705 | G-G-C$^1$-A$^1$-G-G$^1$-Bn-Bn-U$^1$-G-G-Nap-A-Bn-U$^1$-A$^1$-A$^1$-C$^1$-Heg-G$^1$-Bn-Bn-A$^1$-A$^1$-G$^1$-U$^1$-C$^1$-G-Bn-G-G$^1$ | 2.6E-07 | 340 |
| 2573-20_706 | G-G-C$^1$-A$^1$-G-G$^1$-Bn-Bn-U$^1$-G-G-Nap-A-Bn-Bn-A$^1$-A$^1$-C$^1$-Heg-G$^1$-U$^1$-Bn-A$^1$-A$^1$-G$^1$-U$^1$-C$^1$-G-Bn-G-G$^1$ | 6.1E-08 | 341 |
| 2573-20_707 | G-G-C$^1$-A$^1$-G-G$^1$-Bn-Bn-U$^1$-G-G-Nap-A-Bn-Bn-A$^1$-A$^1$-C$^1$-Heg-G$^1$-Bn-U$^1$-A$^1$-A$^1$-G$^1$-U$^1$-C$^1$-G-Bn-G-G$^1$ | 9.4E-08 | 342 |
| 2573-20_718 | G-G-C$^1$-A$^1$-G-G$^1$-BF-Bn-Pe-G-G-Nap-A-Bn-Bn-A$^1$-A$^1$-C$^1$-Heg-G$^1$-Bn-Bn-A$^1$-A$^1$-G$^1$-Bn-C$^1$-G-Bn-G-G$^1$ | 1.1E-08 | 343 |
| 2573-20_721 | G-G-C$^1$-A$^1$-G-G$^1$-BF-Bn-Pe-G-G-Nap-A-Bn-Bn-A$^1$-A$^1$-C$^1$-Heg-G$^1$-Bn-Bn-A$^1$-A$^1$-G$^1$-Bn-C$^1$-G-Ib-G-G$^1$ | 3.8E-08 | 344 |
| 2573-20_723 | G-G-C$^1$-A$^1$-G-G$^1$-BF-Bn-U$^1$-G-G-Nap-A-Bn-Bn-A$^1$-A$^1$-C$^1$-Heg-G$^1$-Bn-Bn-A$^1$-A$^1$-G$^1$-Bn-C$^1$-G-Bn-G-G$^1$ | >1.0E-06 | 345 |
| 2573-20_724 | G-G-C$^1$-A$^1$-G-G$^1$-MBn-Bn-U$^1$-G-G-Nap-A-Bn-Bn-A$^1$-A$^1$-C$^1$-Heg-G$^1$-Bn-Bn-A$^1$-A$^1$-G$^1$-Bn-C$^1$-G-Bn-G-G$^1$ | 1.1E-08 | 346 |
| 2573-20_725 | G-G-C$^1$-A$^1$-G-G$^1$-Bn-Bn-U$^1$-G-G-Nap-A-Bn-Bn-A$^1$-A$^1$-C$^1$-Heg-G$^1$-Bn-Bn-A$^1$-A$^1$-G$^1$-Bn-C$^1$-G-Ib-G-G$^1$ | >1.0E-06 | 347 |
| 2573-20_726 | G-G-C$^1$-A$^1$-G-G$^1$-BF-Bn-U$^1$-G-G-Nap-A-Bn-Bn-A$^1$-A$^1$-C$^1$-Heg-G$^1$-Bn-Bn-A$^1$-A$^1$-G$^1$-Bn-C$^1$-G-Ib-G-G$^1$ | >1.0E-06 | 348 |
| 2573-20_727 | G-G-C$^1$-A$^1$-G-G$^1$-MBn-Bn-U$^1$-G-G-Nap-A-Bn-Bn-A$^1$-A$^1$-C$^1$-Heg-G$^1$-Bn-Bn-A$^1$-A$^1$-G$^1$-Bn-C$^1$-G-Ib-G-G$^1$ | 3.3E-03 | 349 |
| 2573-20_776 | G-G-C$^1$-A-G-G$^1$-MBn-Bn-U$^1$-G-G-Nap-A-Bn-Bn$^1$-A$^1$-A$^1$-C$^1$-Heg-G$^1$-Bn$^1$-Bn$^1$-A$^1$-A$^1$-G$^1$-U$^1$-C$^1$-G$^2$-Bn$^2$-G$^2$-G$^1$ | >1.0E-06 | 350 |
| 2573-20_810 | G-G-C$^1$-A-G-G$^1$-Bn-Bn-U$^1$-G-G-Nap-A-Bn$^2$-Bn$^1$-A$^1$-A-C-A$^1$-C$^1$-Bn-Bn-A$^1$-A-G-Bn-C$^1$-G-Bn$^2$-G-G$^1$ | 1.8E-08 | 351 |
| 2573-20_882 | G-G-C$^1$-A-G-G$^1$-MBn-Bn-U$^1$-G-G-Nap-A-Bn-MOE-A$^1$-A$^1$-C$^1$-Heg-G$^1$-MOE-MOE-A$^1$-A$^1$-G$^1$-U$^1$-C$^1$-G-MOE-G-G$^1$ | >1.0E-06 | 352 |
| 2573-20_883 | G-G-C$^1$-A$^1$-G-G$^1$-MBn-Bn-U$^1$-G-G-Nap-A-Bn-MOE-A$^1$-A$^1$-C$^1$-Heg-G$^1$-MOE-MOE-A$^1$-A$^1$-G$^1$-U$^1$-C$^1$-G-MOE-G-G$^1$ | 2.5E-08 | 353 |
| 2573-20_887 | G-G-C$^1$-A-G-G$^1$-MBn-Bn-MOE-G-G-Nap-A-Bn-MOE-A$^1$-A$^1$-C$^1$-Heg-G$^1$-MOE-MOE-A$^1$-A$^1$-G$^1$-U$^1$-C$^1$-G-MOE-G-G$^1$ | 5.0E-07 | 354 |
| 2573-20_888 | G-G-C$^1$-A$^1$-G-G$^1$-MBn-Bn-MOE-G-G-Nap-A-Bn-MOE-A$^1$-A$^1$-C$^1$-Heg-G$^1$-MOE-MOE-A$^1$-A$^1$-G$^1$-U$^1$-C$^1$-G-MOE-G-G$^1$ | 4.6E-07 | 355 |

TABLE 11-continued

Variants of 2573-20_136 (SEQ ID NO: 101) with IC$_{50}$ greater than $10^{-8}$ M.

| Aptamer | Sequence | IC$_{50}$ (M) | SEQ ID NO |
|---|---|---|---|
| 2573-20_900 | G-G-C$^1$-A$^1$-G-G$^1$-MBn$^1$-Bn$^2$-MOE$^1$-G-G-Nap$^2$-A$^2$-Bn$^2$-MOE$^1$-A$^1$-A$^1$-C$^1$-Heg-G$^1$-MOE$^1$-MOE$^1$-A$^1$-A$^1$-G$^1$-U$^1$-C$^1$-G$^2$-MOE$^2$-G$^2$-G$^1$ | 7.8E-08 | 356 |

No superscript-indicates-deoxyribose
Superscript-o-indicates-2'-fluoro
Superscript-1-indicates-2'-O-methyl
Superscript-2-indicates-phosphorothioate-(deoxyribose)
C3 = -three-carbon-linker
Heg = -hexaethylene-glycol-linker
Nap = -naphthyl-dU
Pe = -phenethyl-dU
BT = -benzothiophenyl-dU
Ib = -isobutyl-dU
2Nap = -2-naphthyl-dU
NE = -naphthylethyl-dU
MBn = -methylenedioxybenzyl-dU
Tyr = -tyrosyl-dU
FBn = -fluorobenzyl-dU
Bn = -benzyl-dU
Trp = -tryptaminyl-dU
Th = -thiophenyl-dU
2NE = -2-naphthylethyl-dU
PP = -phenpropyl-dU
Im = imidazolyl-dU
Thr = threoninyl-dU
CHM = cycohexylmethyl-dU
Pyr = pyridyl-dU
RTM = R-tetrahydrofuranyl-dU
MOE = morpholinoethyl

Example 17

Additional Modifications of 2574-49_260 (SEQ ID NO: 101)

NapdU SOMAmer 2574-49_260 (SEQ ID NO: 400) was further modified using the strategies described in Example 16. Table 12 shows a list of variants that were found to have an IC$_{50}$ ranging from $10^{-11}$ M to $10^{-8}$ M. 2574-49_411 (SEQ ID NO: 443) is a 28-mer with a protective backbone substitution at all but three positions (13 2'-O-methyl, 10 phosphorothioate, and a two C3-spacers), and retains IL-6 antagonist activity (IC$_{50}$=6×10$^{-9}$ M in the Gene Reporter Assay). Table 13 shows a list of variants that were found to have an IC$_{50}$ greater than $10^{-8}$ M.

TABLE 12

Variants of 2574-49_260 (SEQ ID NO: 400) with IC$_{50}$ ranging from $10^{-11}$ M to $10^{-8}$ M.

| Aptamer | Sequence | IC$_{50}$ (M) | SEQ ID NO |
|---|---|---|---|
| 2574-49_260 | C3-G-G-G-Nap-Nap-A-Nap-G-Nap-A-G-C-C3-C3-G-Nap-G-C-G-Nap-A-A-G-G-C-G-G-Nap-G | 9.0E-10 | 400 |
| 2574-49_261 | C3-G-G-G-Nap-Nap-A-Nap-G-Nap-A-G-C-C3-C3-G-Nap-G-C-G-Nap-A-A-G-G-C-G-G-Nap | 5.6E-09 | 401 |
| 2574-49_276 | C3-G$^1$-G$^1$-G$^1$-Nap-Nap-A$^1$-Nap-G$^1$-Nap-A$^1$-G$^1$-C$^1$-C3-C3-G$^1$-Nap-G$^1$-C$^1$-G$^1$-Nap-A$^1$-A$^1$-G$^1$-G$^1$-C$^1$-G$^1$-G$^1$-Nap-G$^1$ | 5.0E-09 | 402 |
| 2574-49_286 | C3-G-G-G-Nap-Nap-A-Nap-G-Nap-A$^0$-G$^0$-C$^0$-C3-C3-G$^0$-Nap-G-C-G-Nap-A-A-G-G-C-G-G-Nap | 6.3E-09 | 403 |
| 2574-49_289 | C3-G-G$^1$-G-Nap-Nap-A-Nap-G-Nap-A-G-C-C3-C3-G-Nap-G$^1$-C-G-Nap-A-A-G-G-C-G-G-Nap | 2.2E-10 | 404 |
| 2574-49_290 | C3-G-G$^1$-G-Nap-Nap-A-Nap-G-Nap-A-G-C-C3-C3-G-Nap-G$^1$-C-G-Nap-A-A-G-G-C-G$^1$-G$^1$-Nap | 8.3E-11 | 405 |
| 2574-49_293 | C3-G-G$^1$-G-Nap$^1$-Nap-A-Nap-G-Nap-A-G-C-C3-C3-G-Nap-G$^1$-C-G-Nap-A-A-G-G-C-G$^1$-G$^1$-Nap | 2.5E-10 | 406 |

TABLE 12-continued

Variants of 2574-49_260 (SEQ ID NO: 400) with IC$_{50}$ ranging from $10^{-11}$ M to $10^{-8}$ M.

| Aptamer | Sequence | IC$_{50}$ (M) | SEQ ID NO |
|---|---|---|---|
| 2574-49_296 | C3-G-G$^1$-G-Nap-Nap-A-Nap-G-Nap$^1$-A-G-C-C3-C3-G-Nap-G$^1$-C-G-Nap-A-A-G-G-C-G$^1$-G$^1$-Nap | 7.4E-10 | 407 |
| 2574-49_297 | C3-G-G$^1$-G-Nap-Nap-A-Nap-G-Nap-A-G-C-C3-C3-G-Nap$^1$-G$^1$-C-G-Nap-A-A-G-G-C-G$^1$-G$^1$-Nap | 7.0E-10 | 408 |
| 2574-49_298 | C3-G-G$^1$-G-Nap-Nap-A-Nap-G-Nap-A-G-C-C3-C3-G-Nap-G$^1$-C-G-Nap$^1$-A-A-G-G-C-G$^1$-G$^1$-Nap | 4.0E-10 | 409 |
| 2574-49_299 | C3-G-G$^1$-G-Nap-Nap-A-Nap-G-Nap-A-G-C-C3-C3-G-Nap-G$^1$-C-G-Nap-A-A-G-G-C-G$^1$-G$^1$-Nap$^1$ | 5.6E-09 | 410 |
| 2574-49_300 | C3-G-G$^1$-G-Nap$^1$-Nap-A-Nap-G-Nap-A-G-C-C3-C3-G-Nap-G$^1$-C-G-Nap-A-A-G-G-C-G$^1$-G$^1$-Nap | 9.8E-09 | 411 |
| 2574-49_302 | C3-G-G$^1$-G-Nap-Nap-A-Nap-G-Nap-A-G-C-C3-C3-G-Nap$^1$-G1-C-G-Nap$^1$-A-A-G-G-C-G$^1$-G$^1$-Nap | 1.6E-10 | 412 |
| 2574-49_304 | C3-G-G$^1$-G-Nap-Nap-A-Nap-G-Nap$^1$-A-G-C-C3-C3-G-Nap$^1$-G$^1$-C-G-Nap$^1$-A-A-G-G-C-G$^1$-G$^1$-Nap | 2.4E-10 | 413 |
| 2574-49_305 | C3-G-G$^1$-G-Nap$^1$-Nap-A-Nap-G-Nap-A-G-C-C3-C3-G-Nap-G$^1$-C-G-Nap-A-A-G-G-C-G$^1$-G$^1$-Nap$^1$ | 1.9E-09 | 414 |
| 2574-49_306 | G-G$^1$-G-Nap-Nap-A-Nap-G-Nap-A-G-C-C3-C3-G-Nap-G$^1$-C-G-Nap-A-A-G-G-C-G$^1$-G$^1$-Nap | 2.1E-09 | 415 |
| 2574-49_313 | G-G$^1$-G-Nap-Nap-A-Nap-G-Nap-A-G-C-C3-C3-G-U$^1$-G$^1$-C-G-Nap-A-A-G-G-C-G$^1$-G$^1$-Nap | 2.9E-09 | 416 |
| 2574-49_316 | G-G$^1$-G-Nap$^1$-Nap-A-Nap-G-Nap$^1$-A-G-C-C3-C3-G-Nap$^1$-G$^1$-C-G-Nap$^1$-A-A-G-G-C-G$^1$-G$^1$-Nap$^1$ | 3.9E-09 | 417 |
| 2574-49_317 | G-G$^1$-G-Nap-Nap-A-Nap-G-Nap$^1$-A-G-C-C3-C3-G-Nap$^1$-G$^1$-C-G-Nap$^1$-A-A-G-G-C-G$^1$-G$^1$-Nap$^1$ | 3.0E-09 | 418 |
| 2574-49_318 | G-G$^1$-G-Nap$^1$-Nap-A-Nap-G-Nap$^1$-A-G-C-C3-C3-G-Nap$^1$-G$^1$-C-G-Nap$^1$-A-A-G-G-C-G$^1$-G$^1$-Nap | 2.0E-09 | 419 |
| 2574-49_326 | G-G$^1$-G-Nap$^1$-Nap-A-Nap-G-Nap$^1$-A-G-C-C3-C3-G-U$^1$-G$^1$-C-G-Nap$^1$-A-A-G-G-C-G$^1$-G$^1$-Nap$^1$ | 1.1E-10 | 420 |
| 2574-49_338 | G-G$^1$-G-Nap$^1$-Nap$^2$-A-Nap-G-Nap$^1$-A-G-C-C3-C3-G$^1$-U$^1$-G$^1$-C-G-Nap$^1$-A-A-G-G-C-G$^1$-G$^1$-Nap$^1$ | 2.0E-11 | 421 |
| 2574-49_339 | G-G$^1$-G-Nap$^1$-Nap$^2$-A-Nap-G-Nap$^1$-A-G-C-C3-C3-G$^1$-U$^1$-G$^1$-C-G-Nap$^1$-A-A-G-G$^2$-C$^2$-G$^1$-G$^1$-Nap$^1$ | 1.1E-10 | 422 |
| 2574-49_340 | G-G$^1$-G-Nap$^1$-Nap$^2$-A-Nap$^2$-G-Nap$^1$-A-G-C-C3-C3-G$^1$-U$^1$-G$^1$-C-G-Nap$^1$-A-A-G-G$^2$-C$^2$-G$^1$-G$^1$-Nap$^1$ | 6.9E-10 | 423 |
| 2574-49_374 | G-G$^1$-G-Nap$^1$-Nap$^2$-A-Nap$^2$-G-MOE$^1$-A-G-C-C3-C3-G$^1$-U$^1$-G$^1$-C-G-Nap$^1$-A-A-G-G$^2$-C$^2$-G$^1$-G$^1$-Nap$^1$ | 4.3E-09 | 424 |
| 2574-49_375 | G-G$^1$-G-Nap$^1$-Nap$^2$-A-Nap$^2$-G-Nap$^1$-A-G-C-C3-C3-G$^1$-MOE$^1$-G$^1$-C-G-Nap$^1$-A-A-G-G$^2$-C$^2$-G$^1$-G$^1$-Nap$^1$ | 3.8E-10 | 425 |
| 2574-49_381 | G-G$^1$-G-Nap$^1$-Nap$^2$-A-Nap$^2$-G-RTM$^1$-A-G-C-C3-C3-G$^1$-U$^1$-G$^1$-C-G-Nap$^1$-A-A-G-G$^2$-C$^2$-G$^1$-G$^1$-Nap$^1$ | 4.7E-09 | 426 |
| 2574-49_382 | G-G$^1$-G-Nap$^1$-Nap$^2$-A-Nap$^2$-G-Nap$^1$-A-G-C-C3-C3-G$^1$-RTM$^1$-G$^1$-C-G-Nap$^1$-A-A-G-G$^2$-C$^2$-G$^1$-G$^1$-Nap$^1$ | 5.5E-10 | 427 |

TABLE 12-continued

Variants of 2574-49_260 (SEQ ID NO: 400) with IC$_{50}$ ranging from $10^{-11}$ M to $10^{-8}$ M.

| Aptamer | Sequence | IC$_{50}$ (M) | SEQ ID NO |
|---|---|---|---|
| 2574-49_387 | G-G$^1$-G-Pyr$^1$-Nap$^2$-A-Nap$^2$-G-Nap$^1$-A-G-C-C3-C3-G$^1$-U$^1$-G$^1$-C-G-Nap$^1$-A-A-G-G$^2$-C$^2$-G$^1$-G$^1$-Nap$^1$ | 6.4E-09 | 428 |
| 2574-49_389 | G-G$^1$-G-Nap$^1$-Nap$^2$-A-Nap$^2$-G-Nap$^1$-A-G-C-C3-C3-G$^1$-Pyr$^1$-G$^1$-C-G-Nap$^1$-A-A-G-G$^2$-C$^2$-G$^1$-G$^1$-Nap$^1$ | 2.8E-09 | 429 |
| 2574-49_390 | G-G$^1$-G-Nap$^1$-Nap$^2$-A-Nap$^2$-G-Nap$^1$-A-G-C-C3-C3-G$^1$-U$^1$-G$^1$-C-G-Pyr$^1$-A-A-G-G$^2$-C$^2$-G$^1$-G$^1$-Nap$^1$ | 3.3E-09 | 430 |
| 2574-49_394 | G-G$^1$-G-MBn$^1$-Nap$^2$-A-Nap$^2$-G-Nap$^1$-A-G-C-C3-C3-G$^1$-U$^1$-G$^1$-C-G-Nap$^1$-A-A-G-G$^2$-C$^2$-G$^1$-G$^1$-Nap$^1$ | 4.5E-09 | 431 |
| 2574-49_395 | G-G$^1$-G-Nap$^1$-Nap$^2$-A-Nap$^2$-G-MBn$^1$-A-G-C-C3-C3-G$^1$-U$^1$-G$^1$-C-G-Nap$^1$-A-A-G-G$^2$-C$^2$-G$^1$-G$^1$-Nap$^1$ | 3.3E-09 | 432 |
| 2574-49_396 | G-G$^1$-G-Nap$^1$-Nap$^2$-A-Nap$^2$-G-Nap$^1$-A-G-C-C3-C3-G$^1$-MBn$^1$-G$^1$-C-G-Nap$^1$-A-A-G-G$^2$-C$^2$-G$^1$-G$^1$-Nap$^1$ | 4.2E-10 | 433 |
| 2574-49_397 | G-G$^1$-G-Nap$^1$-Nap$^2$-A-Nap$^2$-G-Nap$^1$-A-G-C-C3-C3-G$^1$-U$^1$-G$^1$-C-G-MBn$^1$-A-A-G-G$^2$-C$^2$-G$^1$-G$^1$-Nap$^1$ | 3.5E-09 | 434 |
| 2574-49_398 | G-G$^1$-G-Nap$^1$-Nap$^2$-A-Nap$^2$-G-Nap$^1$-A-G-C-C3-C3-G$^1$-U$^1$-G$^1$-C-G-Nap$^1$-A-A-G-G$^2$-C$^2$-G$^1$-G$^1$-MBn$^1$ | 3.0E-10 | 435 |
| 2574-49_402 | G-G$^1$-G-Nap$^1$-Nap$^2$-A-Nap$^2$-G-Nap$^1$-A-G$^1$-C$^1$-C3-C3-G$^1$-U$^1$-G$^1$-C-G-Nap$^1$-A-A-G-G$^2$-C$^2$-G$^1$-G$^1$-Nap$^1$ | 1.6E-09 | 436 |
| 2574-49_404 | G-G$^1$-G-Nap$^1$-Nap$^2$-A-Nap$^2$-G$^1$-Nap$^1$-A-G$^1$-C$^1$-C3-C3-G$^1$-U$^1$-G$^1$-C-G-Nap$^1$-A-A-G-G$^2$-C$^2$-G$^1$-G$^1$-Nap$^1$ | 2.8E-09 | 437 |
| 2574-49_406 | G-G$^1$-G-Nap$^1$-Nap$^2$-A-Nap$^2$-G-Nap$^1$-A-G$^1$-C$^1$-C3-C3-G$^1$-U$^1$-G$^1$-C-G-Nap$^1$-A-A-G-G$^1$-C$^2$-G$^1$-G$^1$-Nap$^1$ | 2.4E-09 | 438 |
| 2574-49_407 | G-G$^1$-G-Nap$^1$-Nap$^2$-A-Nap$^2$-G-Nap$^1$-A-G$^1$-C$^1$-C3-C3-G$^1$-U$^1$-G$^1$-C$^2$-G$^2$-Nap$^1$-A-A-G-G$^1$-C$^2$-G$^1$-G$^1$-Nap$^1$ | 2.1E-09 | 439 |
| 2574-49_408 | G-G$^1$-G-Nap$^1$-Nap$^2$-A-Nap$^2$-G-Nap$^1$-A-G$^1$-C$^1$-C3-C3-G$^1$-U$^1$-G$^1$-C-G-Nap$^1$-A$^2$-A$^2$-G$^2$-G$^1$-C$^2$-G$^1$-G$^1$-Nap$^1$ | 9.2E-09 | 440 |
| 2574-49_409 | G-G$^1$-G-Nap$^1$-Nap$^2$-A-Nap$^2$-G-Nap$^1$-A-G$^1$-C$^1$-C3-C3-G$^1$-U$^1$-G$^1$-C$^2$-G$^2$-Nap$^1$-A$^2$-A$^2$-G$^2$-G$^1$-C$^2$-G$^1$-G$^1$-Nap$^1$ | 7.5E-09 | 441 |
| 2574-49_410 | G-G$^1$-G-Nap$^1$-Nap$^2$-A-Nap$^2$-G-Nap$^1$-A$^2$-G$^1$-C$^1$-C3-C3-G$^1$-U$^1$-G$^1$-C-G-Nap$^1$-A-A-G-G$^2$-C$^2$-G$^1$-G$^1$-Nap$^1$ | 3.8E-09 | 442 |
| 2574-49_411 | G-G$^1$-G-Nap$^1$-Nap$^2$-A$^2$-Nap$^2$-G-Nap$^1$-A$^2$-G$^1$-C$^1$-C3-C3-G$^1$-U$^1$-G$^1$-C$^2$-G$^2$-Nap$^1$-A$^2$-A$^2$-G$^2$-G$^1$-C$^2$-G$^1$-G$^1$-Nap$^1$ | 5.8E-09 | 443 |
| 2574-49_413 | G-G$^1$-G-Nap$^1$-Nap$^2$-A-Nap$^2$-G-Nap$^1$-A-G$^1$-C$^1$-C3$^2$-C3$^2$-G$^1$-U$^1$-G$^1$-C$^2$-G$^2$-Nap$^1$-A$^2$-A$^2$-G$^2$-G$^1$-C$^2$-G$^1$-G$^1$-Nap$^1$ | 8.6E-09 | 444 |
| 2574-49_416 | G-G$^1$-G-Nap$^1$-Nap$^2$-A-Nap$^2$-G-Nap$^1$-A-G$^1$-C$^1$-C3-C3$^2$-G$^1$-U$^1$-G$^1$-C-G-Nap$^1$-A-A-G-G$^1$-C$^2$-G$^1$-G$^1$-Nap$^1$ | 3.1E-09 | 445 |

TABLE 12-continued

Variants of 2574-49_260 (SEQ ID NO: 400) with IC$_{50}$ ranging from $10^{-11}$ M to $10^{-8}$ M.

| Aptamer | Sequence | IC$_{50}$ (M) | SEQ ID NO |
|---|---|---|---|
| 2574-49_417 | G-G$^1$-G-Nap$^1$-Nap$^2$-A$^2$-Nap$^2$-G-Nap$^1$-A$^2$-G$^1$-C$^1$-C3-C3-G$^1$-U$^1$-G$^1$-C-G-Nap$^1$-A-A-G-G$^1$-C$^2$-G$^1$-G$^1$-Nap$^1$ | 4.4E-09 | 446 |

No superscript indicates deoxyribose
Superscript o indicates 2'-fluoro
Superscript 1 indicates 2'-O-methyl
Superscript 2 indicates phosphorothioate (deoxyribose)
C3 = three-carbon-linker
Heg = hexaethylene-glycol-linker
Nap = naphthyl-dU
Pe = phenethyl-dU
BT = benzothiophenyl-dU
Ib = isobutyl-dU
2Nap = 2-naphthyl-dU
NE = naphthylethyl-dU
MBn = methylenedioxybenzyl-dU
Tyr = tyrosyl-dU
FBn = fluorobenzyl-dU
Bn = benzyl-dU
Trp = tryptaminyl-dU
Th = thiophenyl-dU
2NE = 2-naphthylethyl-dU
PP = phenpropyl-dU
Im = imidazolyl-dU
Thr = threoninyl-dU
CHM = cycohexylmethyl-dU
Pyr = pyridyl-dU
RTM = R-tetrahydrofuranyl-dU
MOE = morpholinoethyl

TABLE 13

Variants of 2574-49_260 (SEQ ID NO: 400) with IC$_{50}$ greater than $10^{-8}$ M.

| Aptamer | Sequence | IC$_{50}$ (M) | SEQ ID NO |
|---|---|---|---|
| 2574-49_277 | C3-C3-C3-C3-Nap-Nap-A-Nap-G-Nap-A-G-C-C3-C3-G-Nap-G-C-G-Nap-A-A-G-G-C-G-G-Nap | 1.2E-08 | 500 |
| 2574-49_281 | C3-G$^1$-G$^1$-G$^1$-Nap-Nap-A-Nap-G-Nap-A-G-C-C3-C3-G-Nap-G-C-G-Nap-A-A-G-G-C-G-G-Nap | 1.1E-07 | 501 |
| 2574-49_282 | C3-G-G-G-Nap-Nap-A-Nap-G-Nap-A$^1$-G$^1$-C$^1$-C3-C3-G$^1$-Nap-G-C-G-Nap-A-A-G-G-C-G-G-Nap | 1.4E-08 | 502 |
| 2574-49_285 | C3-G$^0$-G$^0$-G$^0$-Nap-Nap-A-Nap-G-Nap-A-G-C-C3-C3-G-Nap-G-C-G-Nap-A-A-G-G-C-G-G-Nap- | 1.0E-08 | 503 |
| 2574-49_287 | C3-G-G-G-Nap-Nap-A-Nap-G-Nap-A-G-C-C3-C3-G-Nap-G$^0$-C$^0$-G$^0$-Nap-A-A-G-G-C-G-G-Nap | 1.1E-08 | 504 |
| 2574-49_288 | C3-G-G-G-Nap-Nap-A-Nap-G-Nap-A-G-C-C3-C3-G-Nap-G-C-G-Nap-A$^0$-A$^0$-G$^0$-G$^0$-C$^0$-G$^0$-G$^0$-Nap | >1.0E-06 | 505 |
| 2574-49_291 | G$^1$-G$^1$-G$^1$-G$^1$-Nap$^1$-Nap$^1$-A$^1$-Nap$^1$-G$^1$-Nap$^1$-A$^1$-G$^1$-C$^1$-G$^1$-A$^1$-G$^1$-Nap$^1$-G$^1$-C$^1$-G$^1$-Nap$^1$-A$^1$-A$^1$-G$^1$-G$^1$-C$^1$-G$^1$-G$^1$-Nap$^1$ | >1.0E-06 | 506 |
| 2574-49_292 | G$^1$-G$^1$-G$^1$-G$^1$-U$^1$-U$^1$-A$^1$-U$^1$-G$^1$-U$^1$-A$^1$-G$^1$-C$^1$-G$^1$-A$^1$-G$^1$-U$^1$-G$^1$-C$^1$-G$^1$-U$^1$-A$^1$-A$^1$-G$^1$-G$^1$-C$^1$-G$^1$-G$^1$-U$^1$ | >1.0E-06 | 507 |
| 2574-49_294 | C3-G-G$^1$-G-Nap-Nap$^1$-A-Nap-G-Nap-A-G-C-C3-C3-G-Nap-G$^1$-C-G-Nap-A-A-G-G-C-G$^1$-G$^1$-Nap | 2.8E-08 | 508 |
| 2574-49_295 | C3-G-G$^1$-G-Nap-Nap-A-Nap$^1$-G-Nap-A-G-C-C3-C3-G-Nap-G$^1$-C-G-Nap-A-A-G-G-C-G$^1$-G$^1$-Nap | 1.8E-08 | 509 |

TABLE 13-continued

Variants of 2574-49_260 (SEQ ID NO: 400) with IC$_{50}$ greater than 10$^{-8}$ M.

| Aptamer | Sequence | IC$_{50}$ (M) | SEQ ID NO |
|---|---|---|---|
| 2574-49_301 | C3-G-G$^1$-G-Nap-Nap-A-Nap$^1$-G-Nap$^1$-A-G-C-C3-C3-G-Nap-G$^1$-C-G-Nap-A-A-G-G-C-G$^1$-G$^1$-Nap | 7.2E-08 | 510 |
| 2574-49_303 | C3-G-G$^1$-G-Nap$^1$-Nap$^1$-A-Nap$^1$-G-Nap-A-G-C-C3-C3-G-Nap-G$^1$-C-G-Nap-A-A-G-G-C-G$^1$-G$^1$-Nap | 2.4E-07 | 511 |
| 2574-49_307 | G$^1$-G-Nap-Nap-A-Nap-G-Nap-A-G-C-C3-C3-G-Nap-G$^1$-C-G-Nap-A-A-G-G-C-G$^1$-G$^1$-Nap | 2.5E-08 | 512 |
| 2574-49_308 | C3-G-G$^1$-G-Nap$^1$-Nap$^1$-A-Nap$^1$-G-Nap$^1$-A-G-C-C3-C3-G-Nap$^1$-G$^1$-C-G-Nap-A-A-G-G-C-G$^1$-G$^1$-Nap$^1$ | 8.8E-08 | 513 |
| 2574-49_309 | G-G$^1$-G-U$^1$-Nap-A-Nap-G-Nap-A-G-C-C3-C3-G-Nap-G$^1$-C-G-Nap-A-A-G-G-C-G$^1$-G$^1$-Nap | >1.0E-06 | 514 |
| 2574-49_310 | G-G$^1$-G-Nap-U$^1$-A-Nap-G-Nap-A-G-C-C3-C3-G-Nap-G$^1$-C-G-Nap-A-A-G-G-C-G$^1$-G$^1$-Nap | >1.0E-06 | 515 |
| 2574-49_311 | G-G$^1$-G-Nap-Nap-A-U$^1$-G-Nap-A-G-C-C3-C3-G-Nap-G$^1$-C-G-Nap-A-A-G-G-C-G$^1$-G$^1$-Nap | >1.0E-06 | 516 |
| 2574-49_312 | G-G$^1$-G-Nap-Nap-A-Nap-G-U$^1$-A-G-C-C3-C3-G-Nap-G$^1$-C-G-Nap-A-A-G-G-C-G$^1$-G$^1$-Nap | >1.0E-06 | 517 |
| 2574-49_314 | G-G$^1$-G-Nap-Nap-A-Nap-G-Nap-A-G-C-C3-C3-G-Nap-G$^1$-C-G-U$^1$-A-A-G-G-C-G$^1$-G$^1$-Nap | 1.9E-08 | 518 |
| 2574-49_315 | G-G$^1$-G-Nap-Nap-A-Nap-G-Nap-A-G-C-C3-C3-G-Nap-G$^1$-C-G-Nap-A-A-G-G-C-G$^1$-G$^1$-U$^1$ | >1.0E-06 | 519 |
| 2574-49_319 | G$^1$-G$^1$-G$^1$-Nap$^1$-Nap$^1$-A$^1$-Nap$^1$-G$^1$-Nap$^1$-A$^1$-G$^1$-C$^1$-C3-C3-G$^1$-U$^1$-G$^1$-C$^1$-G$^1$-Nap$^1$-A$^1$-A$^1$-G$^1$-G$^1$-C$^1$-G$^1$-G$^1$-Nap$^1$ | 2.2E-07 | 520 |
| 2574-49_325 | G$^0$-G$^0$-G$^0$-Nap$^1$-Nap$^1$-A$^0$-Nap$^1$-G$^0$-Nap$^1$-A$^0$-G$^0$-C$^0$-C3-C3-G$^0$-U$^1$-G$^0$-C$^0$-G$^0$-Nap$^1$-A$^0$-A$^0$-G$^0$-G$^0$-C$^0$-G$^0$-G$^0$-Nap$^1$ | 9.2E-08 | 521 |
| 2574-49_335 | G$^1$-G$^1$-G$^1$-Nap$^1$-Nap$^1$-A$^1$-Nap$^1$-G$^1$-Nap$^1$-A$^1$-G$^1$-C$^1$-G$^1$-A$^1$-G$^1$-U$^1$-G$^1$-C$^1$-G$^1$-Nap$^1$-A$^1$-A$^1$-G$^1$-G$^1$-C$^1$-G$^1$-G$^1$-Nap$^1$ | 6.2E-08 | 522 |
| 2574-49_341 | G$^1$-G$^1$-G$^1$-Nap$^1$-Nap$^2$-A$^1$-Nap$^2$-G$^1$-Nap$^1$-A$^1$-G$^1$-C$^1$-C3-C3-G$^1$-U$^1$-G$^1$-C$^1$-G$^1$-Nap$^1$-A$^1$-A$^1$-G$^1$-G$^1$-C$^1$-G$^1$-G$^1$-Nap$^1$ | 4.3E-08 | 523 |
| 2574-49_342 | G-G$^1$-G-Nap$^1$-Nap$^2$-A-Nap$^2$-G-Nap$^1$-A-G-C$^1$-C3-C3-G$^1$-U$^1$-G$^1$-C-G-Nap$^1$-A$^1$-A-G-G$^2$-C$^2$-G$^1$-G$^1$-Nap$^1$ | 1.4E-08 | 524 |
| 2574-49_373 | G-G$^1$-G-MOE$^1$-Nap$^2$-A-Nap$^2$-G-Nap$^1$-A-G-C-C3-C3-G$^1$-U$^1$-G$^1$-C-G-Nap$^1$-A-A-G-G$^2$-C$^2$-G$^1$-G$^1$-Nap$^1$ | 1.5E-08 | 525 |
| 2574-49_376 | G-G$^1$-G-Nap$^1$-Nap$^2$-A-Nap$^2$-G-Nap$^1$-A-G-C-C3-C3-G$^1$-U$^1$-G$^1$-C-G-MOE$^1$-A-A-G-G$^2$-C$^2$-G$^1$-G$^1$-Nap$^1$ | >1.0E-06 | 526 |
| 2574-49_377 | G-G$^1$-G-Nap$^1$-Nap$^2$-A-Nap$^2$-G-Nap$^1$-A-G-C-C3-C3-G$^1$-U$^1$-G$^1$-C-G-Nap$^1$-A-A-G-G$^2$-C$^2$-G$^1$-G$^1$-MOE$^1$ | 1.8E-08 | 527 |
| 2574-49_378 | G-G$^1$-G-Nap$^1$-MOE$^2$-A-Nap$^2$-G-Nap$^1$-A-G-C-C3-C3-G$^1$-U$^1$-G$^1$-C-G-Nap$^1$-A-A-G-G$^2$-C$^2$-G$^1$-G$^1$-Nap$^1$ | >1.0E-06 | 528 |
| 2574-49_379 | G-G$^1$-G-Nap$^1$-Nap$^2$-A-MOE$^2$-G-Nap$^1$-A-G-C-C3-C3-G$^1$-U$^1$-G$^1$-C-G-Nap$^1$-A-A-G-G$^2$-C$^2$-G$^1$-G$^1$-Nap$^1$ | >1.0E-06 | 529 |
| 2574-49_380 | G-G$^1$-G-RTM$^1$-Nap$^2$-A-Nap$^2$-G-Nap$^1$-A-G-C-C3-C3-G$^1$-U$^1$-G$^1$-C-G-Nap$^1$-A-A-G-G$^2$-C$^2$-G$^1$-G$^1$-Nap$^1$ | 1.8E-08 | 530 |
| 2574-49_383 | G-G$^1$-G-Nap$^1$-Nap$^2$-A-Nap$^2$-G-Nap$^1$-A-G-C-C3-C3-G$^1$-U$^1$-G$^1$-C-G-RTM$^1$-A-A-G-G$^2$-C$^2$-G$^1$-G$^1$-Nap$^1$ | >1.0E-06 | 531 |
| 2574-49_384 | G-G$^1$-G-Nap$^1$-Nap$^2$-A-Nap$^2$-G-Nap$^1$-A-G-C-C3-C3-G$^1$-U$^1$-G$^1$-C-G-Nap$^1$-A-A-G-G$^2$-C$^2$-G$^1$-G$^1$-RTM | 5.7E-08 | 532 |
| 2574-49_388 | G-G$^1$-G-Nap$^1$-Nap$^2$-A-Nap$^2$-G-Pyr$^1$-A-G-C-C3-C3-G$^1$-U$^1$-G$^1$-C-G-Nap$^1$-A-A-G-G$^2$-C$^2$-G$^1$-G$^1$-Nap$^1$ | 9.7E-08 | 533 |

TABLE 13-continued

Variants of 2574-49_260 (SEQ ID NO: 400) with IC$_{50}$ greater than $10^{-8}$ M.

| Aptamer | Sequence | IC$_{50}$ (M) | SEQ ID NO |
|---|---|---|---|
| 2574-49_391 | G-G$^1$-G-Nap$^1$-Nap$^2$-A-Nap$^2$-G-Nap$^1$-A-G-C-C3-C3-G$^1$-U$^1$-G$^1$-C-G-Nap$^1$-A-A-G-G$^2$-C$^2$-G$^1$-G$^1$-Pyr$^1$ | 1.2E-08 | 534 |
| 2574-49_392 | G-G$^1$-G-Nap$^1$-Pyr$^2$-A-Nap$^2$-G-Nap$^1$-A-G-C-C3-C3-G$^1$-U$^1$-G$^1$-C-G-Nap$^1$-A-A-G-G$^2$-C$^2$-G$^1$-G$^1$-Nap$^1$ | 2.9E-08 | 535 |
| 2574-49_393 | G-G$^1$-G-Nap$^1$-Nap$^2$-A-Pyr$^2$-G-Nap$^1$-A-G-C-C3-C3-G$^1$-U$^1$-G$^1$-C-G-Nap$^1$-A-A-G-G$^2$-C$^2$-G$^1$-G$^1$-Nap$^1$ | >1.0E-06 | 536 |
| 2574-49_399 | G-G$^1$-G-Nap$^1$-MBn$^2$-A-Nap$^2$-G-Nap$^1$-A-G-C-C3-C3-G$^1$-U$^1$-G$^1$-C-G-Nap$^1$-A-A-G-G$^2$-C$^2$-G$^1$-G$^1$-Nap$^1$ | 4.9E-07 | 537 |
| 2574-49_400 | G-G$^1$-G-Nap$^1$-Nap$^2$-A-MBn$^2$-G-Nap$^1$-A-G-C-C3-C3-G$^1$-U$^1$-G$^1$-C-G-Nap$^1$-A-A-G-G$^2$-C$^2$-G$^1$-G$^1$-Nap$^1$ | >1.0E-06 | 538 |
| 2574-49_403 | G$^1$-G$^1$-G$^1$-Nap$^1$-Nap$^2$-A-Nap$^2$-G-Nap$^1$-A-G$^1$-C$^1$-C3-C3-G$^1$-U$^1$-G$^1$-C-G-Nap$^1$-A-A-G-G$^1$-C$^2$-G$^1$-G$^1$-Nap$^1$ | 4.9E-08 | 539 |
| 2574-49_405 | G$^1$-G$^1$-G$^1$-Nap$^1$-Nap$^2$-A-Nap$^2$-G-Nap$^1$-A-G-C$^1$-C3-C3-G$^1$-U$^1$-G$^1$-C-G-Nap$^1$-A-A-G-G$^1$-C$^2$-G$^1$-G$^1$-Nap$^1$ | 4.4E-08 | 540 |
| 2574-49_412 | G$^2$-G$^1$-G$^2$-Nap$^1$-Nap$^2$-A$^2$-Nap$^2$-G$^2$-Nap$^1$-A$^2$-G$^1$-C$^1$-C3$^2$-C3$^2$-G$^1$-U$^1$-G$^1$-C$^2$-G$^2$-Nap$^1$-A$^2$-A$^2$-G$^2$-G$^1$-C$^2$-G$^1$-G$^1$-Nap$^1$ | 7.7E-08 | 541 |
| 2574-49_414 | G$^2$-G$^1$-G$^2$-Nap$^1$-Nap$^2$-A$^2$-Nap$^2$-G$^2$-Nap$^1$-A$^2$-G$^1$-C$^1$-C3-C3$^2$-G$^1$-U$^1$-G$^1$-C$^2$-G$^2$-Nap$^1$-A$^2$-A$^2$-G$^2$-G$^1$-C$^2$-G$^1$-G$^1$-Nap$^1$ | 2.7E-08 | 542 |
| 2574-49_415 | G-G$^1$-G-Nap$^1$-Nap$^2$-A-Nap$^2$-G-Nap$^1$-A-G$^1$-C$^1$-C3-C3$^2$-G$^1$-U$^1$-G$^1$-C-G-Nap$^1$-A-A-G-G$^1$-C$^2$-G$^1$-G$^1$-Nap$^1$ | 1.7E-08 | 543 |
| 2574-49_418 | G-G$^1$-G-Nap$^1$-Nap$^2$-A$^2$-Nap$^2$-G-Nap$^1$-A$^2$-G$^1$-C$^1$-C3-C3-G$^1$-U$^1$-G$^1$-C$^2$-G$^2$-Nap$^1$-A$^2$-A$^2$-G$^2$-G$^1$-C$^2$-G$^1$-G$^1$-Nap$^1$ | 4.0E-08 | 544 |
| 2574-49_419 | G-G$^1$-G-Nap$^1$-Nap$^2$-A$^2$-Nap$^2$-G$^1$-Nap$^1$-A$^2$-G$^1$-C$^1$-C3-C3$^2$-G$^1$-U$^1$-G$^1$-C$^2$-G$^2$-Nap$^1$-A$^2$-A$^2$-G$^2$-G$^1$-C$^2$-G$^1$-G$^1$-Nap$^1$ | 4.0E-08 | 545 |
| 2574-49_420 | G$^2$-G$^1$-G$^2$-Nap$^1$-Nap$^2$-A$^2$-Nap$^2$-G$^1$-Nap$^1$-A$^2$-G$^1$-C$^1$-C3-C3-G$^1$-U$^1$-G$^1$-C$^2$-G$^2$-Nap$^1$-A$^2$-A$^2$-G$^2$-G$^1$-C$^2$-G$^1$-G$^1$-Nap$^1$ | 8.0E-08 | 546 |
| 2574-49_421 | G$^2$-G$^1$-G$^2$-Nap$^1$-Nap$^2$-A$^2$-Nap$^2$-G$^1$-Nap$^1$-A$^2$-G$^1$-C$^1$-C3-C3$^2$-G$^1$-U$^1$-G$^1$-C$^2$-G$^2$-Nap$^1$-A$^2$-A$^2$-G$^2$-G$^1$-C$^2$-G$^1$-G$^1$-Nap$^1$ | 9.7E-08 | 547 |
| 2574-49_422 | G-G$^1$-G-Nap$^1$-Nap$^2$-A$^2$-Nap$^2$-G$^1$-MOE$^1$-A$^2$-G$^1$-C$^1$-C3-C3-G$^1$-U$^1$-G$^1$-C$^2$-G$^2$-Nap$^1$-A$^2$-A$^2$-G$^2$-G$^1$-C$^2$-G$^1$-G$^1$-Nap$^1$ | 2.6E-07 | 548 |
| 2574-49_423 | G-G$^1$-G-Nap$^1$-Nap$^2$-A$^2$-Nap$^2$-G$^1$-MOE$^1$-A$^2$-G$^1$-C$^1$-C3-C3-G$^1$-MOE$^1$-G$^1$-C$^2$-G$^2$-Nap$^1$-A$^2$-A$^2$-G$^2$-G$^1$-C$^2$-G$^1$-G$^1$-Nap$^1$ | 2.4E-07 | 549 |
| 2574-49_424 | G-G$^1$-G-Pyr$^1$-Nap$^2$-A$^2$-Nap$^2$-G$^1$-MOE$^1$-A$^2$-G$^1$-C$^1$-C3-C3-G$^1$-U$^1$-G$^1$-C$^2$-G$^2$-Nap$^1$-A$^2$-A$^2$-G$^2$-G$^1$-C$^2$-G$^1$-G$^1$-Nap$^1$ | >1.0E-06 | 550 |
| 2574-49_425 | G-G$^1$-G-Nap$^1$-Nap$^2$-A$^2$-Nap$^2$-G$^1$-MOE$^1$-A$^2$-G$^1$-C$^1$-C3-C3-G$^1$-U$^1$-G$^1$-C$^2$-G$^2$-Pyr$^1$-A$^2$-A$^2$-G$^2$-G$^1$-C$^2$-G$^1$-G$^1$-Nap$^1$ | >1.0E-06 | 551 |
| 2574-49_426 | G-G$^1$-G-Pyr$^1$-Nap$^2$-A$^2$-Nap$^2$-G$^1$-MOE$^1$-A$^2$-G$^1$-C$^1$-C3-C3-G$^1$-U$^1$-G$^1$-C$^2$-G$^2$-Pyr$^1$-A$^2$-A$^2$-G$^2$-G$^1$-C$^2$-G$^1$-G$^1$-Nap$^1$ | >1.0E-06 | 552 |
| 2574-49_427 | G-G$^1$-G-Pyr$^1$-Nap$^2$-A$^2$-Nap$^2$-G$^1$-MOE$^1$-A$^2$-G$^1$-C$^1$-C3-C3-G$^1$-MOE$^1$-G$^1$-C$^2$-G$^2$-Pyr$^1$-A$^2$-A$^2$-G$^2$-G$^1$-C$^2$-G$^1$-G$^1$-Nap$^1$ | >1.0E-06 | 553 |
| 2574-49_428 | G-G$^1$-G-Pyr$^1$-Nap$^2$-A$^2$-Nap$^2$-G$^1$-MOE$^1$-A$^2$-G$^1$-C$^1$-C3-C3-G$^1$-MOE$^1$-G$^1$-C$^2$-G$^2$-Pyr$^1$-A$^2$-A$^2$-G$^2$-G$^1$-C$^2$-G$^1$-G$^1$-MBn$^1$ | >1.0E-06 | 554 |
| 2574-49_429 | G-G$^1$-G-Nap$^1$-Nap$^2$-A$^2$-Nap$^2$-G$^1$-Nap$^1$-A$^2$-G$^1$-C$^1$-C3-C3-G$^1$-U$^1$-G$^1$-C$^2$-G$^2$-Nap$^1$-A$^2$-A$^2$-G$^2$-G$^1$-C$^2$-G$^1$-G$^1$-MBn$^1$ | 5.4E-08 | 555 |
| 2574-49_430 | G$^2$-G$^1$-G$^2$-Nap$^1$-Nap$^2$-A$^2$-Nap$^2$-G$^1$-MOE$^1$-A$^2$-G$^1$-C$^1$-C3-C3-G$^1$-U$^1$-G$^1$-C$^2$-G$^2$-Nap$^1$-A$^2$-A$^2$-G$^2$-G$^1$-C$^2$-G$^1$-G$^1$-Nap$^1$ | 6.1E-07 | 556 |
| 2574-49_431 | G$^2$-G$^1$-G$^2$-Nap$^1$-Nap$^2$-A$^2$-Nap$^2$-G$^1$-MOE$^1$-A$^2$-G$^1$-C$^1$-C3-C3-G$^1$-MOE$^1$-G$^1$-C$^2$-G$^2$-Nap$^1$-A$^2$-A$^2$-G$^2$-G$^1$-C$^2$-G$^1$-G$^1$-Nap$^1$ | >1.0E-06 | 557 |

TABLE 13-continued

Variants of 2574-49_260 (SEQ ID NO: 400) with IC$_{50}$ greater than 10$^{-8}$ M.

| Aptamer | Sequence | IC$_{50}$ (M) | SEQ ID NO |
|---|---|---|---|
| 2574-49_432 | G$^2$-G$^1$-G$^2$-Pyr$^1$-Nap$^2$-A$^2$-Nap$^2$-G$^1$-MOE$^1$-A$^2$-G$^1$-C$^1$-C3-C3-G$^1$-U$^1$-G$^1$-C$^2$-G$^2$-Nap$^1$-A$^2$-A$^2$-G$^2$-G$^1$-C$^2$-G$^1$-G$^1$-Nap$^1$ | >1.0E-06 | 558 |
| 2574-49_433 | G$^2$-G$^1$-G$^2$-Nap$^1$-Nap$^2$-A$^2$-Nap$^2$-G$^1$-MOE$^1$-A$^2$-G$^1$-C$^1$-C3-C3-G$^1$-U$^1$-G$^1$-C$^2$-G$^2$-Pyr$^1$-A$^2$-A$^2$-G$^2$-G$^1$-C$^2$-G$^1$-G$^1$-Nap$^1$ | >1.0E-06 | 559 |
| 2574-49_434 | G$^2$-G$^1$-G$^2$-Pyr$^1$-Nap$^2$-A$^2$-Nap$^2$-G$^1$-MOE$^1$-A$^2$-G$^1$-C$^1$-C3-C3-G$^1$-U$^1$-G$^1$-C$^2$-G$^2$-Pyr$^1$-A$^2$-A$^2$-G$^2$-G$^1$-C$^2$-G$^1$-G$^1$-Nap$^1$ | >1.0E-06 | 560 |
| 2574-49_435 | G$^2$-G$^1$-G$^2$-Pyr$^1$-Nap$^2$-A$^2$-Nap$^2$-G$^1$-MOE$^1$-A$^2$-G$^1$-C$^1$-C3-C3-G$^1$-MOE$^1$-G$^1$-C$^2$-G$^2$-Pyr$^1$-A$^2$-A$^2$-G$^2$-G$^1$-C$^2$-G$^1$-G$^1$-Nap$^1$ | >1.0E-06 | 561 |
| 2574-49_436 | G$^2$-G$^1$-G$^2$-Pyr$^1$-Nap$^2$-A$^2$-Nap$^2$-G$^1$-MOE$^1$-A$^2$-G$^1$-C$^1$-C3-C3-G$^1$-MOE$^1$-G$^1$-C$^2$-G$^2$-Pyr$^1$-A$^2$-A$^2$-G$^2$-G$^1$-C$^2$-G$^1$-G$^1$-MBn$^1$ | >1.0E-06 | 562 |
| 2574-49_437 | G$^2$-G$^1$-G$^2$-Nap$^1$-Nap$^2$-A$^2$-Nap$^2$-G$^1$-Nap$^1$-A$^2$-G$^1$-C$^1$-C3-C3-G$^1$-U$^1$-G$^1$-C$^2$-G$^2$-Nap$^1$-A$^2$-A$^2$-G$^2$-G$^1$-C$^2$-G$^1$-G$^1$-MBn$^1$ | 1.3E-07 | 563 |
| 2574-49_438 | G$^2$-G$^1$-G$^2$-Nap$^1$-Nap$^2$-A$^2$-Nap$^2$-G$^1$-MOE$^1$-A$^2$-G$^1$-C$^1$-C3-C3$^2$-G$^1$-U$^1$-G$^1$-C$^2$-G$^2$-Nap$^1$-A$^2$-A$^2$-G$^2$-G$^1$-C$^2$-G$^1$-G$^1$-Nap$^1$ | 7.8E-07 | 564 |
| 2574-49_439 | G$^2$-G$^1$-G$^2$-Nap$^1$-Nap$^2$-A$^2$-Nap$^2$-G$^1$-MOE$^1$-A$^2$-G$^1$-C$^1$-C3-C3$^2$-G$^1$-MOE$^1$-G$^1$-C$^2$-G$^2$-Nap$^1$-A$^2$-A$^2$-G$^2$-G$^1$-C$^2$-G$^1$-G$^1$-Nap$^1$ | >1.0E-06 | 565 |
| 2574-49_440 | G$^2$-G$^1$-G$^2$-Pyr$^1$-Nap$^2$-A$^2$-Nap$^2$-G$^1$-MOE$^1$-A$^2$-G1-C$^1$-C3-C3$^2$-G$^1$-U$^1$-G$^1$-C$^2$-G$^2$-Nap$^1$-A$^2$-A$^2$-G$^2$-G$^1$-C$^2$-G$^1$-G$^1$-Nap$^1$ | >1.0E-06 | 566 |
| 2574-49_441 | G$^2$-G$^1$-G$^2$-Nap$^1$-Nap$^2$-A$^2$-Nap$^2$-G$^1$-MOE$^1$-A$^2$-G$^1$-C$^1$-C3-C3$^2$-G$^1$-U$^1$-G$^1$-C$^2$-G$^2$-Pyr$^1$-A$^2$-A$^2$-G$^2$-G$^1$-C$^2$-G$^1$-G$^1$-Nap$^1$ | >1.0E-06 | 567 |
| 2574-49_442 | G$^2$-G$^1$-G$^2$-Pyr$^1$-Nap$^2$-A$^2$-Nap$^2$-G$^1$-MOE$^1$-A$^2$-G$^1$-C$^1$-C3-C3$^2$-G$^1$-U$^1$-G$^1$-C$^2$-G$^2$-Pyr$^1$-A$^2$-A$^2$-G$^2$-G$^1$-C$^2$-G$^1$-G$^1$-Nap$^1$ | >1.0E-06 | 568 |
| 2574-49_443 | G$^2$-G$^1$-G$^2$-Pyr$^1$-Nap$^2$-A$^2$-Nap$^2$-G$^1$-MOE$^1$-A$^2$-G$^1$-C$^1$-C3-C3$^2$-G$^1$-MOE$^1$-G$^1$-C$^2$-G$^2$-Pyr$^1$-A$^2$-A$^2$-G$^2$-G$^1$-C$^2$-G$^1$-G$^1$-Nap$^1$ | >1.0E-06 | 569 |
| 2574-49_444 | G$^2$-G$^1$-G$^2$-Pyr$^1$-Nap$^2$-A$^2$-Nap$^2$-G$^1$-MOE$^1$-A$^2$-G$^1$-C$^1$-C3-C3$^2$-G$^1$-MOE$^1$-G$^1$-C$^2$-G$^2$-Pyr$^1$-A$^2$-A$^2$-G$^2$-G$^1$-C$^2$-G$^1$-G$^1$-MBn$^1$ | >1.0E-06 | 570 |
| 2574-49_445 | G$^2$-G$^1$-G$^2$-Nap$^1$-Nap$^2$-A$^2$-Nap$^2$-G$^1$-Nap$^1$-A$^2$-G$^1$-C$^1$-C3-C3$^2$-G$^1$-U$^1$-G$^1$-C$^2$-G$^2$-Nap$^1$-A$^2$-A$^2$-G$^2$-G$^1$-C$^2$-G$^1$-G$^1$-MBn$^1$ | 1.4E-07 | 571 |
| 2574-49_456 | - G-G-G-T-T-A-T-G-T-A-G-C-G-A-G-T-G-C-G-T-A-A-G-G-C-G-G-T-G | >1.0E-06 | 572 |

No superscript-indicates-deoxyribose
Superscript-o-indicates-2'-fluoro
Superscript-1-indicates-2'-O-methyl
Superscript-2-indicates-phosphorothioate-(deoxyribose)
C3 = -three-carbon-linker
Heg = -hexaethylene-glycol-linker
Nap = -naphthyl-dU
Pe = -phenethyl-dU
BT = -benzothiophenyl-dU
Ib = -isobutyl-dU
2Nap = -2-naphthyl-dU
NE = -naphthylethyl-dU
MBn = -methylenedioxybenzyl-dU
Tyr = -tyrosyl-dU
FBn = -fluorobenzyl-dU
Bn = -benzyl-dU
Trp = -tryptaminyl-dU
Th = -thiophenyl-dU
2NE = -2-naphthylethyl-dU
PP = -phenpropyl-dU
Im = imidazolyl-dU
Thr = threoninyl-dU
CHM = cycohexylmethyl-dU
Pyr = pyridyl-dU
RTM = R-tetrahydrofuranyl-dU
MOE = morpholinoethyl

SEQUENCE LISTING (707 sequences)

SEQ ID NO: 1 - DNA, 88 bp, Artificial Sequence
  Description of Artificial Sequence: Synthetic oligonucleotide
  modified_base (1)..(2): a-biotin
  modified_base (31)..(70): a, c, t, g, unknown or other
aattttttttggtcttgtttcttctctgtgnnnnnnnnnnnnnnnnnnnnnnnnnnnnnnnnnnnnnnnntcgtcacacactcacatc

SEQ ID NO: 2 - DNA, 19 bp, Artificial Sequence
  Description of Artificial Sequence: Synthetic primer
  5' Cy3
gatgtgagtgtgtgacgag

SEQ ID NO: 3 - DNA, 27 bp, Artificial Sequence
  Description of Artificial Sequence: Synthetic primer
atatatatgatgtgagtgtgtgacgag

SEQ ID NO: 4 - DNA, 30 bp, Artificial Sequence
  Description of Artificial Sequence: Synthetic primer
  modified_base (1)..(2): a-biotin
aattttttttggtcttgtttcttctctgtg

SEQ ID NO: 5-6 - skipped (2 entries)

SEQ ID NO: 7 - DNA, 78 bp, Artificial Sequence
  Description of Artificial Sequence: Synthetic oligonucleotide
  Description of Combined DNA/RNA Molecule: Synthetic oligonucleotide
  modified_base (20)..(20): Bn-dU
  modified_base (28)..(30): Bn-dU
  modified_base (33)..(33): Bn-dU
  modified_base (35)..(36): Bn-dU
  modified_base (43)..(44): Bn-dU
  modified_base (48)..(48): Bn-dU
  modified_base (51)..(51): Bn-dU
  modified_base (56)..(56): Bn-dU
gatgtgagtgtgtgacgagugggcagguuugguauuaacacguuaagucguggggucgcacagagaagaaacaagacc

SEQ ID NO: 8 - DNA, 79 bp, Artificial Sequence
  Description of Artificial Sequence: Synthetic oligonucleotide
  Description of Combined DNA/RNA Molecule: Synthetic oligonucleotide
  modified_base (24)..(25): Nap-dU
  modified_base (27)..(27): Nap-dU
  modified_base (29)..(29): Nap-dU
  modified_base (36)..(36): Nap-dU
  modified_base (40)..(40): Nap-dU
  modified_base (48)..(48): Nap-dU
  modified_base (59)..(59): Nap-dU
gatgtgagtgtgtgacgaggggguuauguagcgagugcguaaggcggugggcgagggaucacagagaagaaacaagacc

SEQ ID NO: 9 - protein, 212 aa, Homo sapiens
MNSFSTSAFGPVAFSLGLLLVLPAAFPAPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 10 - protein, 184 aa, Homo sapiens
PVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 11 - DNA, 36 bp, Artificial Sequence
  Description of Artificial Sequence: Synthetic oligonucleotide
  Description of Combined DNA/RNA Molecule: Synthetic oligonucleotide
  modified_base (7)..(9): Bn-dU
  modified_base (12)..(12): Bn-dU
  modified_base (14)..(15): Bn-dU
  modified_base (22)..(23): Bn-dU
  modified_base (27)..(27): Bn-dU
  modified_base (30)..(30): Bn-dU
  modified_base (35)..(35): Bn-dU
ggcagguuugguauuaacacguuaagucgugggguc

SEQ ID NO: 12 - DNA, 35 bp, Artificial Sequence
  Description of Artificial Sequence: Synthetic oligonucleotide
  Description of Combined DNA/RNA Molecule: Synthetic oligonucleotide
  modified_base (6)..(8): Bn-dU
  modified_base (11)..(11): Bn-dU
  modified_base (13)..(14): Bn-dU
  modified_base (21)..(22): Bn-dU
  modified_base (26)..(26): Bn-dU
  modified_base (29)..(29): Bn-dU
  modified_base (34)..(34): Bn-dU
gcagguuugguauuaacacguuaagucgugggguc

SEQ ID NO: 13 - DNA, 34 bp, Artificial Sequence
  Description of Artificial Sequence: Synthetic oligonucleotide
  Description of Combined DNA/RNA Molecule: Synthetic oligonucleotide
  modified_base (5)..(7): Bn-dU
  modified_base (10)..(10): Bn-dU
  modified_base (12)..(13): Bn-dU
  modified_base (20)..(21): Bn-dU
  modified_base (25)..(25): Bn-dU
  modified_base (28)..(28): Bn-dU
  modified_base (33)..(33): Bn-dU
cagguuugguauuaacacguuaagucgugggguc

SEQ ID NO: 14 - DNA, 33 bp, Artificial Sequence
  Description of Artificial Sequence: Synthetic oligonucleotide
  Description of Combined DNA/RNA Molecule: Synthetic oligonucleotide
  modified_base (4)..(6): Bn-dU
  modified_base (9)..(9): Bn-dU
  modified_base (11)..(12): Bn-dU
  modified_base (19)..(20): Bn-dU
  modified_base (24)..(24): Bn-dU
  modified_base (27)..(27): Bn-dU
  modified_base (32)..(32): Bn-dU
agguuugguauuaacacguuaagucgugggguc

SEQ ID NO: 15 - DNA, 32 bp, Artificial Sequence
  Description of Artificial Sequence: Synthetic oligonucleotide
  Description of Combined DNA/RNA Molecule: Synthetic oligonucleotide
  modified_base (3)..(5): Bn-dU
  modified_base (8)..(8): Bn-dU
  modified_base (10)..(11): Bn-dU
  modified_base (18)..(19): Bn-dU
  modified_base (23)..(23): Bn-dU
  modified_base (26)..(26): Bn-dU
  modified_base (31)..(31): Bn-dU
gguuugguauuaacacguuaagucgugggguc

SEQ ID NO: 16 - DNA, 31 bp, Artificial Sequence
  Description of Artificial Sequence: Synthetic oligonucleotide
  Description of Combined DNA/RNA Molecule: Synthetic oligonucleotide
  modified_base (2)..(4): Bn-dU
  modified_base (7)..(7): Bn-dU
  modified_base (9)..(10): Bn-dU
  modified_base (17)..(18): Bn-dU
  modified_base (22)..(22): Bn-dU
  modified_base (25)..(25): Bn-dU
  modified_base (30)..(30): Bn-dU
guuugguauuaacacguuaagucgugggguc

SEQ ID NO: 17 - DNA, 30 bp, Artificial Sequence
  Description of Artificial Sequence: Synthetic oligonucleotide
  Description of Combined DNA/RNA Molecule: Synthetic oligonucleotide
  modified_base (1)..(3): Bn-dU
  modified_base (6)..(6): Bn-dU
  modified_base (8)..(9): Bn-dU
  modified_base (16)..(17): Bn-dU
  modified_base (21)..(21): Bn-dU
  modified_base (24)..(24): Bn-dU
  modified_base (29)..(29): Bn-dU
uuugguauuaacacguuaagucgugggguc

SEQ ID NO: 18 - DNA, 29 bp, Artificial Sequence
  Description of Artificial Sequence: Synthetic oligonucleotide
  Description of Combined DNA/RNA Molecule: Synthetic oligonucleotide
  modified_base (1)..(2): Bn-dU
  modified_base (5)..(5): Bn-dU
  modified_base (7)..(8): Bn-dU
  modified_base (15)..(16): Bn-dU
  modified_base (20)..(20): Bn-dU
  modified_base (23)..(23): Bn-dU
  modified_base (28)..(28): Bn-dU
uugguauuaacacguuaagucgugggguc

SEQ ID NO: 19 - DNA, 35 bp, Artificial Sequence
  Description of Artificial Sequence: Synthetic oligonucleotide
  Description of Combined DNA/RNA Molecule: Synthetic oligonucleotide
  modified_base (7)..(9): Bn-dU
  modified_base (12)..(12): Bn-dU
  modified_base (14)..(15): Bn-dU
  modified_base (22)..(23): Bn-dU
  modified_base (27)..(27): Bn-dU
  modified_base (30)..(30): Bn-dU
  modified_base (35)..(35): Bn-dU
ggcagguuugguauuaacacguuaagucguggggu

SEQ ID NO: 20 - DNA, 34 bp, Artificial Sequence
  Description of Artificial Sequence: Synthetic oligonucleotide
  Description of Combined DNA/RNA Molecule: Synthetic oligonucleotide
  modified_base (7)..(9): Bn-dU
  modified_base (12)..(12): Bn-dU
  modified_base (14)..(15): Bn-dU
  modified_base (22)..(23): Bn-dU
  modified_base (27)..(27): Bn-dU
  modified_base (30)..(30): Bn-dU
ggcagguuugguauuaacacguuaagucgugggg

SEQ ID NO: 21 - DNA, 33 bp, Artificial Sequence
  Description of Artificial Sequence: Synthetic oligonucleotide
  Description of Combined DNA/RNA Molecule: Synthetic oligonucleotide
  modified_base (7)..(9): Bn-dU
  modified_base (12)..(12): Bn-dU
  modified_base (14)..(15): Bn-dU
  modified_base (22)..(23): Bn-dU
  modified_base (27)..(27): Bn-dU
  modified_base (30)..(30): Bn-dU
ggcagguuugguauuaacacguuaagucguggg

SEQ ID NO: 22 - DNA, 32 bp, Artificial Sequence
  Description of Artificial Sequence: Synthetic oligonucleotide
  Description of Combined DNA/RNA Molecule: Synthetic oligonucleotide
  modified_base (7)..(9): Bn-dU
  modified_base (12)..(12): Bn-dU
  modified_base (14)..(15): Bn-dU
  modified_base (22)..(23): Bn-dU
  modified_base (27)..(27): Bn-dU
  modified_base (30)..(30): Bn-dU
ggcagguuugguauuaacacguuaagucgugg

SEQ ID NO: 23 - DNA, 31 bp, Artificial Sequence
  Description of Artificial Sequence: Synthetic oligonucleotide
  Description of Combined DNA/RNA Molecule: Synthetic oligonucleotide
  modified_base (7)..(9): Bn-dU
  modified_base (12)..(12): Bn-dU
  modified_base (14)..(15): Bn-dU
  modified_base (22)..(23): Bn-dU
  modified_base (27)..(27): Bn-dU
  modified_base (30)..(30): Bn-dU
ggcagguuugguauuaacacguuaagucgug

SEQ ID NO: 24 - DNA, 30 bp, Artificial Sequence
  Description of Artificial Sequence: Synthetic oligonucleotide
  Description of Combined DNA/RNA Molecule: Synthetic oligonucleotide
  modified_base (7)..(9): Bn-dU
  modified_base (12)..(12): Bn-dU
  modified_base (14)..(15): Bn-dU
  modified_base (22)..(23): Bn-dU
  modified_base (27)..(27): Bn-dU
  modified_base (30)..(30): Bn-dU
ggcagguuugguauuaacacguuaagucgu

SEQ ID NO: 25 - DNA, 29 bp, Artificial Sequence
  Description of Artificial Sequence: Synthetic oligonucleotide
  Description of Combined DNA/RNA Molecule: Synthetic oligonucleotide
  modified_base (7)..(9): Bn-dU
  modified_base (12)..(12): Bn-dU
  modified_base (14)..(15): Bn-dU
  modified_base (22)..(23): Bn-dU
  modified_base (27)..(27): Bn-dU
ggcagguuugguauuaacacguuaagucg

SEQ ID NO: 26 - DNA, 39 bp, Artificial Sequence
  Description of Artificial Sequence: Synthetic oligonucleotide
  Description of Combined DNA/RNA Molecule: Synthetic oligonucleotide
  modified_base (5)..(6): Nap-dU
  modified_base (8)..(8): Nap-dU
  modified_base (10)..(10): Nap-dU
  modified_base (17)..(17): Nap-dU
  modified_base (21)..(21): Nap-dU
  modified_base (29)..(29): Nap-dU
gggguuauguagcgagugcguaaggcggugggcgaggga

SEQ ID NO: 27 - DNA, 38 bp, Artificial Sequence
  Description of Artificial Sequence: Synthetic oligonucleotide
  Description of Combined DNA/RNA Molecule: Synthetic oligonucleotide
  modified_base (5)..(6): Nap-dU
  modified_base (8)..(8): Nap-dU
  modified_base (10)..(10): Nap-dU
  modified_base (17)..(17): Nap-dU
  modified_base (21)..(21): Nap-dU
  modified_base (29)..(29): Nap-dU
gggguuauguagcgagugcguaaggcggugggcgaggg

SEQ ID NO: 28 - DNA, 37 bp, Artificial Sequence
  Description of Artificial Sequence: Synthetic oligonucleotide
  Description of Combined DNA/RNA Molecule: Synthetic oligonucleotide
  modified_base (5)..(6): Nap-dU
  modified_base (8)..(8): Nap-dU
  modified_base (10)..(10): Nap-dU
  modified_base (17)..(17): Nap-dU
  modified_base (21)..(21): Nap-dU
  modified_base (29)..(29): Nap-dU
gggguuauguagcgagugcguaaggcggugggcgagg

SEQ ID NO: 29 - DNA, 36 bp, Artificial Sequence
  Description of Artificial Sequence: Synthetic oligonucleotide
  Description of Combined DNA/RNA Molecule: Synthetic oligonucleotide
  modified_base (5)..(6): Nap-dU
  modified_base (8)..(8): Nap-dU
  modified_base (10)..(10): Nap-dU
  modified_base (17)..(17): Nap-dU
  modified_base (21)..(21): Nap-dU
  modified_base (29)..(29): Nap-dU
gggguuauguagcgagugcguaaggcggugggcgag

SEQ ID NO: 30 - DNA, 35 bp, Artificial Sequence
  Description of Artificial Sequence: Synthetic oligonucleotide
  Description of Combined DNA/RNA Molecule: Synthetic oligonucleotide
  modified_base (5)..(6): Nap-dU
  modified_base (8)..(8): Nap-dU
  modified_base (10)..(10): Nap-dU
  modified_base (17)..(17): Nap-dU
  modified_base (21)..(21): Nap-dU
  modified_base (29)..(29): Nap-dU
gggguuauguagcgagugcguaaggcggugggcga

SEQ ID NO: 31 - DNA, 34 bp, Artificial Sequence
  Description of Artificial Sequence: Synthetic oligonucleotide
  Description of Combined DNA/RNA Molecule: Synthetic oligonucleotide
  modified_base (5)..(6): Nap-dU
  modified_base (8)..(8): Nap-dU
  modified_base (10)..(10): Nap-dU
  modified_base (17)..(17): Nap-dU
  modified_base (21)..(21): Nap-dU
  modified_base (29)..(29): Nap-dU
gggguuauguagcgagugcguaaggcggugggcg

SEQ ID NO: 32 - DNA, 33 bp, Artificial Sequence
  Description of Artificial Sequence: Synthetic oligonucleotide
  Description of Combined DNA/RNA Molecule: Synthetic oligonucleotide
  modified_base (5)..(6): Nap-dU
  modified_base (8)..(8): Nap-dU
  modified_base (10)..(10): Nap-dU
  modified_base (17)..(17): Nap-dU
  modified_base (21)..(21): Nap-dU
  modified_base (29)..(29): Nap-dU
gggguuauguagcgagugcguaaggcggugggc

SEQ ID NO: 33 - DNA, 32 bp, Artificial Sequence
  Description of Artificial Sequence: Synthetic oligonucleotide
  Description of Combined DNA/RNA Molecule: Synthetic oligonucleotide
  modified_base (5)..(6): Nap-dU
  modified_base (8)..(8): Nap-dU
  modified_base (10)..(10): Nap-dU
  modified_base (17)..(17): Nap-dU
  modified_base (21)..(21): Nap-dU
  modified_base (29)..(29): Nap-dU
gggguuauguagcgagugcguaaggcgguggg

SEQ ID NO: 34 - DNA, 31 bp, Artificial Sequence
  Description of Artificial Sequence: Synthetic oligonucleotide
  Description of Combined DNA/RNA Molecule: Synthetic oligonucleotide
  modified_base (5)..(6): Nap-dU
  modified_base (8)..(8): Nap-dU
  modified_base (10)..(10): Nap-dU
  modified_base (17)..(17): Nap-dU
  modified_base (21)..(21): Nap-dU
  modified_base (29)..(29): Nap-dU
gggguuauguagcgagugcguaaggcggugg

SEQ ID NO: 35 - DNA, 30 bp, Artificial Sequence
  Description of Artificial Sequence: Synthetic oligonucleotide
  Description of Combined DNA/RNA Molecule: Synthetic oligonucleotide
  modified_base (5)..(6): Nap-dU
  modified_base (8)..(8): Nap-dU
  modified_base (10)..(10): Nap-dU
  modified_base (17)..(17): Nap-dU
  modified_base (21)..(21): Nap-dU
  modified_base (29)..(29): Nap-dU
gggguuauguagcgagugcguaaggcggug

SEQ ID NO: 36 - DNA, 38 bp, Artificial Sequence
  Description of Artificial Sequence: Synthetic oligonucleotide
  Description of Combined DNA/RNA Molecule: Synthetic oligonucleotide
  modified_base (4)..(5): Nap-dU
  modified_base (7)..(7): Nap-dU
  modified_base (9)..(9): Nap-dU
  modified_base (16)..(16): Nap-dU
  modified_base (20)..(20): Nap-dU
  modified_base (28)..(28): Nap-dU
ggguuauguagcgagugcguaaggcggugggcgaggga

SEQ ID NO: 37 - DNA, 37 bp, Artificial Sequence
  Description of Artificial Sequence: Synthetic oligonucleotide
  Description of Combined DNA/RNA Molecule: Synthetic oligonucleotide
  modified_base (3)..(4): Nap-dU
  modified_base (6)..(6): Nap-dU
  modified_base (8)..(8): Nap-dU
  modified_base (15)..(15): Nap-dU
  modified_base (19)..(19): Nap-dU
  modified_base (27)..(27): Nap-dU
gguuauguagcgagugcguaaggcggugggcgaggga

SEQ ID NO: 38 - DNA, 36 bp, Artificial Sequence
  Description of Artificial Sequence: Synthetic oligonucleotide
  Description of Combined DNA/RNA Molecule: Synthetic oligonucleotide
  modified_base (2)..(3): Nap-dU
  modified_base (5)..(5): Nap-dU
  modified_base (7)..(7): Nap-dU
  modified_base (14)..(14): Nap-dU
  modified_base (18)..(18): Nap-dU
  modified_base (26)..(26): Nap-dU
guuauguagcgagugcguaaggcggugggcgaggga

SEQ ID NO: 39 - DNA, 35 bp, Artificial Sequence
  Description of Artificial Sequence: Synthetic oligonucleotide
  Description of Combined DNA/RNA Molecule: Synthetic oligonucleotide
  modified_base (1)..(2): Nap-dU
  modified_base (4)..(4): Nap-dU
  modified_base (6)..(6): Nap-dU
  modified_base (13)..(13): Nap-dU
  modified_base (17)..(17): Nap-dU
  modified_base (25)..(25): Nap-dU
uuauguagcgagugcguaaggcggugggcgaggga

SEQ ID NO: 40 - DNA, 34 bp, Artificial Sequence
  Description of Artificial Sequence: Synthetic oligonucleotide
  Description of Combined DNA/RNA Molecule: Synthetic oligonucleotide
  modified_base (1)..(1): Nap-dU
  modified_base (3)..(3): Nap-dU
  modified_base (5)..(5): Nap-dU
  modified_base (12)..(12): Nap-dU
  modified_base (16)..(16): Nap-dU
  modified_base (24)..(24): Nap-dU
uauguagcgagugcguaaggcggugggcgaggga

SEQ ID NO: 41 - DNA, 33 bp, Artificial Sequence
  Description of Artificial Sequence: Synthetic oligonucleotide
  Description of Combined DNA/RNA Molecule: Synthetic oligonucleotide
  modified_base (2)..(2): Nap-dU
  modified_base (4)..(4): Nap-dU
  modified_base (11)..(11): Nap-dU
  modified_base (15)..(15): Nap-dU
  modified_base (23)..(23): Nap-dU
auguagcgagugcguaaggcggugggcgaggga

SEQ ID NO: 42-99 - skipped (58 entries)

SEQ ID NO: 100 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): benzyl-dU
  modified_base (12)..(12): benzyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (27)..(27): benzyl-dU
  modified_base (28)..(28): 2'-O-methyl-c
  modified_base (30)..(30): benzyl-dU

SEQ ID NO: 101 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (27)..(27): benzyl-dU
  modified_base (28)..(28): 2'-O-methyl-c
  modified_base (30)..(30): benzyl-dU

SEQ ID NO: 102 - DNA, 31 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  misc_feature (26)..(27): C3 linker between nucleotides
  modified_base (27)..(27): 2'-O-methyl-c
  modified_base (29)..(29): benzyl-dU
ggcagguuugguauuaacacguuaagcgugg

SEQ ID NO: 103 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (27)..(27): 2'-O-methyl-u
  modified_base (28)..(28): 2'-O-methyl-c
  modified_base (30)..(30): benzyl-dU

SEQ ID NO: 104 - DNA, 31 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (27)..(27): benzyl-dU
  misc_feature (27)..(28): C3 linker between nucleotides
  modified_base (29)..(29): benzyl-dU
ggcagguuugguauuaacacguuaagugugg

SEQ ID NO: 105 - DNA, 30 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  misc_feature (26)..(27): C3 linker between nucleotides-C3 linker between nucleotides
  modified_base (28)..(28): benzyl-dU
ggcagguuugguauuaacacguuaaggugg

SEQ ID NO: 106 - DNA, 30 bp, Artificial Sequence; identical to SEQ ID NO: 105
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  misc_feature (26)..(27): Heg linker between nucleotides
  modified_base (28)..(28): benzyl-dU

SEQ ID NO: 107 - DNA, 30 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (18)..(19): Heg linker between nucleotides
  modified_base (20)..(20): benzyl-dU
  modified_base (21)..(21): benzyl-dU
  modified_base (25)..(25): benzyl-dU
  modified_base (26)..(26): 2'-O-methyl-c
  modified_base (28)..(28): benzyl-dU
ggcagguuugguauuaacguuaagucgugg

SEQ ID NO: 108 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (17)..(18): Heg linker between nucleotides
  modified_base (18)..(18): benzyl-dU
  modified_base (19)..(19): benzyl-dU
  modified_base (23)..(23): benzyl-dU
  modified_base (24)..(24): 2'-O-methyl-c
  modified_base (26)..(26): benzyl-dU
ggcagguuugguauuaauuaagucgugg

SEQ ID NO: 109 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (17)..(18): C3 linker between nucleotides-C3 linker between nucleotides
  modified_base (18)..(18): benzyl-dU
  modified_base (19)..(19): benzyl-dU
  modified_base (23)..(23): benzyl-dU
  modified_base (24)..(24): 2'-O-methyl-c
  modified_base (26)..(26): benzyl-dU
ggcagguuugguauuaauuaagucgugg

SEQ ID NO: 110 - DNA, 30 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (18)..(19): Heg linker between nucleotides
  modified_base (19)..(19): benzothiophenyl-dU
  modified_base (20)..(20): benzyl-dU
  modified_base (21)..(21): benzyl-dU
  modified_base (25)..(25): benzyl-dU
  modified_base (26)..(26): 2'-O-methyl-c
  modified_base (28)..(28): benzyl-dU
ggcagguuugguauuaacuuuaagucgugg

SEQ ID NO: 111 - DNA, 30 bp, Artificial Sequence; identical to SEQ ID NO: 110
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (18)..(19): Heg linker between nucleotides
  modified_base (19)..(19): methylenedioxybenzyl-dU
  modified_base (20)..(20): benzyl-dU
  modified_base (21)..(21): benzyl-dU
  modified_base (25)..(25): benzyl-dU
  modified_base (26)..(26): 2'-O-methyl-c
  modified_base (28)..(28): benzyl-dU

SEQ ID NO: 112 - DNA, 30 bp, Artificial Sequence; identical to SEQ ID NO: 110
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (18)..(19): Heg linker between nucleotides
  modified_base (19)..(19): naphthylethyl-dU
  modified_base (20)..(20): benzyl-dU
  modified_base (21)..(21): benzyl-dU
  modified_base (25)..(25): benzyl-dU
  modified_base (26)..(26): 2'-O-methyl-c
  modified_base (28)..(28): benzyl-dU

SEQ ID NO: 113 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (27)..(27): benzyl-dU
  modified_base (28)..(28): 2'-O-methyl-c
  modified_base (30)..(30): benzyl-dU

SEQ ID NO: 114 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (17)..(18): Heg linker between nucleotides
  modified_base (18)..(18): phenethyl-dU
  modified_base (19)..(19): benzyl-dU
  modified_base (23)..(23): benzyl-dU
  modified_base (24)..(24): 2'-O-methyl-c
  modified_base (26)..(26): benzyl-dU
ggcagguuugguauuaauuaagucgugg

SEQ ID NO: 115 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): 2'-O-methyl-u
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (27)..(27): benzyl-dU
  modified_base (28)..(28): 2'-O-methyl-c
  modified_base (30)..(30): benzyl-dU

SEQ ID NO: 116 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): 2'-O-methyl-u
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (27)..(27): benzyl-dU
  modified_base (28)..(28): 2'-O-methyl-c
  modified_base (30)..(30): benzyl-dU

SEQ ID NO: 117 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): 2'-O-methyl-u
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (27)..(27): benzyl-dU
  modified_base (28)..(28): 2'-O-methyl-c
  modified_base (30)..(30): benzyl-dU

SEQ ID NO: 118 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): 2'-O-methyl-u
  modified_base (23)..(23): benzyl-dU
  modified_base (27)..(27): benzyl-dU
  modified_base (28)..(28): 2'-O-methyl-c
  modified_base (30)..(30): benzyl-dU

SEQ ID NO: 119 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): 2'-O-methyl-u
  modified_base (27)..(27): benzyl-dU
  modified_base (28)..(28): 2'-O-methyl-c
  modified_base (30)..(30): benzyl-dU

SEQ ID NO: 120 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (17)..(18): Heg linker between nucleotides
  modified_base (18)..(18): benzyl-dU
  modified_base (19)..(19): benzyl-dU
  modified_base (20)..(20): 2'-O-methyl-a
  modified_base (23)..(23): 2'-O-methyl-u
  modified_base (24)..(24): 2'-O-methyl-c
  modified_base (26)..(26): benzyl-dU
ggcagguuugguauuaauuaagucgugg

SEQ ID NO: 121 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (17)..(18): Heg linker between nucleotides
  modified_base (18)..(18): tyrosyl-dU
  modified_base (19)..(19): benzyl-dU
  modified_base (20)..(20): 2'-O-methyl-a
  modified_base (23)..(23): 2'-O-methyl-u
  modified_base (24)..(24): 2'-O-methyl-c
  modified_base (26)..(26): benzyl-dU
ggcagguuugguauuaauuaagucgugg

SEQ ID NO: 122 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (17)..(18): Heg linker between nucleotides
  modified_base (18)..(18): benzyl-dU
  modified_base (19)..(19): tyrosyl-dU
  modified_base (20)..(20): 2'-O-methyl-a
  modified_base (23)..(23): 2'-O-methyl-u
  modified_base (24)..(24): 2'-O-methyl-c
  modified_base (26)..(26): benzyl-dU
ggcagguuugguauuaauuaagucgugg

SEQ ID NO: 123 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (17)..(18): Heg linker between nucleotides
  modified_base (18)..(18): fluorobenzyl-dU
  modified_base (19)..(19): benzyl-dU
  modified_base (20)..(20): 2'-O-methyl-a
  modified_base (23)..(23): 2'-O-methyl-u
  modified_base (24)..(24): 2'-O-methyl-c
  modified_base (26)..(26): benzyl-dU
ggcagguuugguauuaauuaagucgugg

SEQ ID NO: 124 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (17)..(18): Heg linker between nucleotides
  modified_base (18)..(18): fluorobenzyl-dU
  modified_base (19)..(19): tyrosyl-dU
  modified_base (20)..(20): 2'-O-methyl-a
  modified_base (23)..(23): benzyl-dU
  modified_base (24)..(24): 2'-O-methyl-c
  modified_base (26)..(26): benzyl-dU
ggcagguuugguauuaauuaagucgugg

SEQ ID NO: 125 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (18)..(19): Heg linker between nucleotides
  modified_base (20)..(20): benzyl-dU
  modified_base (21)..(21): benzyl-dU
  modified_base (22)..(22): 2'-O-methyl-a
  modified_base (25)..(25): 2'-O-methyl-u
  modified_base (26)..(26): 2'-O-methyl-c
  modified_base (28)..(28): benzyl-dU

SEQ ID NO: 126 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (18)..(19): Heg linker between nucleotides
  modified_base (20)..(20): benzyl-dU
  modified_base (21)..(21): benzyl-dU
  modified_base (22)..(22): 2'-O-methyl-a
  modified_base (25)..(25): benzyl-dU
  modified_base (26)..(26): 2'-O-methyl-c
  modified_base (28)..(28): benzyl-dU

SEQ ID NO: 127 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (18)..(19): Heg linker between nucleotides
  modified_base (20)..(20): benzyl-dU
  modified_base (21)..(21): benzyl-dU
  modified_base (22)..(22): 2'-O-methyl-a
  modified_base (25)..(25): 2'-O-methyl-u
  modified_base (26)..(26): 2'-O-methyl-c
  modified_base (28)..(28): benzyl-dU

SEQ ID NO: 128 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (18)..(19): Heg linker between nucleotides
  modified_base (20)..(20): fluorobenzyl-dU
  modified_base (21)..(21): benzyl-dU
  modified_base (22)..(22): 2'-O-methyl-a
  modified_base (25)..(25): 2'-O-methyl-u
  modified_base (26)..(26): 2'-O-methyl-c
  modified_base (28)..(28): benzyl-dU

SEQ ID NO: 129 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (18)..(19): Heg linker between nucleotides
  modified_base (20)..(20): benzyl-dU
  modified_base (21)..(21): tyrosyl-dU
  modified_base (22)..(22): 2'-O-methyl-a
  modified_base (25)..(25): 2'-O-methyl-u
  modified_base (26)..(26): 2'-O-methyl-c
  modified_base (28)..(28): benzyl-dU

SEQ ID NO: 130 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (18)..(19): Heg linker between nucleotides
  modified_base (20)..(20): tyrosyl-dU
  modified_base (21)..(21): benzyl-dU
  modified_base (22)..(22): 2'-O-methyl-a
  modified_base (25)..(25): 2'-O-methyl-u
  modified_base (26)..(26): 2'-O-methyl-c
  modified_base (28)..(28): benzyl-dU

SEQ ID NO: 131 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (18)..(19): Heg linker between nucleotides
  modified_base (20)..(20): fluorobenzyl-dU
  modified_base (21)..(21): tyrosyl-dU
  modified_base (22)..(22): 2'-O-methyl-a
  modified_base (25)..(25): 2'-O-methyl-u
  modified_base (26)..(26): 2'-O-methyl-c
  modified_base (28)..(28): benzyl-dU

SEQ ID NO: 132 - DNA, 31 bp, Artificial Sequence; identical to SEQ ID NO: 104
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (24)..(24): 2'-O-methyl-a
  modified_base (27)..(27): 2'-O-methyl-u
  misc_feature (27)..(28): C3 linker between nucleotides
  modified_base (29)..(29): benzyl-dU

SEQ ID NO: 133 - DNA, 31 bp, Artificial Sequence; identical to SEQ ID NO: 104
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (24)..(24): 2'-O-methyl-a
  modified_base (27)..(27): 2'-O-methyl-u
  misc_feature (27)..(28): C3 linker between nucleotides
  modified_base (29)..(29): benzyl-dU

SEQ ID NO: 134 - DNA, 29 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (18)..(19): Heg linker between nucleotides
  modified_base (20)..(20): benzyl-dU
  modified_base (21)..(21): benzyl-dU
  modified_base (22)..(22): 2'-O-methyl-a
  modified_base (25)..(25): 2'-O-methyl-u
  misc_feature (25)..(26): C3 linker between nucleotides
  modified_base (27)..(27): benzyl-dU
ggcagguuugguauuaacguuaagugugg

SEQ ID NO: 135 - DNA, 29 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (18)..(19): Heg linker between nucleotides
  modified_base (20)..(20): benzyl-dU
  modified_base (21)..(21): benzyl-dU
  modified_base (22)..(22): 2'-O-methyl-a
  modified_base (25)..(25): 2'-O-methyl-u
  misc_feature (25)..(26): C3 linker between nucleotides
  modified_base (27)..(27): benzyl-dU
ggcagguuugguauuaacguuaagugugg

SEQ ID NO: 136 - DNA, 27 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (17)..(18): Heg linker between nucleotides
  modified_base (18)..(18): benzyl-dU
  modified_base (19)..(19): benzyl-dU
  modified_base (20)..(20): 2'-O-methyl-a
  modified_base (23)..(23): 2'-O-methyl-u
  misc_feature (23)..(24): C3 linker between nucleotides
  modified_base (25)..(25): benzyl-dU
ggcagguuugguauuaauuaagugugg

SEQ ID NO: 137 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (18)..(19): Heg linker between nucleotides
  modified_base (20)..(20): benzyl-dU
  modified_base (21)..(21): benzyl-dU
  modified_base (22)..(22): 2'-O-methyl-a
  misc_feature (24)..(25): Heg linker between nucleotides
  modified_base (26)..(26): benzyl-dU
ggcagguuugguauuaacguuaaggugg

SEQ ID NO: 138 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (1)..(1): 2'-fluoro-g
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (24)..(24): 2'-O-methyl-a
  modified_base (27)..(27): benzyl-dU
  modified_base (28)..(28): 2'-O-methyl-c
  modified_base (30)..(30): benzyl-dU

SEQ ID NO: 139 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (2)..(2): 2'-fluoro-g
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (24)..(24): 2'-O-methyl-a
  modified_base (27)..(27): benzyl-dU
  modified_base (28)..(28): 2'-O-methyl-c
  modified_base (30)..(30): benzyl-dU

SEQ ID NO: 140 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (11)..(11): 2'-fluoro-g
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (24)..(24): 2'-O-methyl-a
  modified_base (27)..(27): benzyl-dU
  modified_base (28)..(28): 2'-O-methyl-c
  modified_base (30)..(30): benzyl-dU

SEQ ID NO: 141 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (21)..(21): 2'-fluoro-g
  modified_base (22)..(22): benzyl-dU
  modified_base (23)..(23): benzyl-dU
  modified_base (24)..(24): 2'-O-methyl-a
  modified_base (27)..(27): benzyl-dU
  modified_base (28)..(28): 2'-O-methyl-c
  modified_base (30)..(30): benzyl-dU

SEQ ID NO: 142 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (24)..(24): 2'-O-methyl-a
  modified_base (26)..(26): 2'-fluoro-g
  modified_base (27)..(27): benzyl-dU
  modified_base (28)..(28): 2'-O-methyl-c
  modified_base (30)..(30): benzyl-dU

SEQ ID NO: 143 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (24)..(24): 2'-O-methyl-a
  modified_base (27)..(27): benzyl-dU
  modified_base (28)..(28): 2'-O-methyl-c
  modified_base (29)..(29): 2'-fluoro-g
  modified_base (30)..(30): benzyl-dU

SEQ ID NO: 144 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (24)..(24): 2'-O-methyl-a
  modified_base (27)..(27): benzyl-dU
  modified_base (28)..(28): 2'-O-methyl-c
  modified_base (30)..(30): benzyl-dU
  modified_base (32)..(32): 2'-fluoro-g

SEQ ID NO: 145 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-fluoro-a
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (24)..(24): 2'-O-methyl-a
  modified_base (27)..(27): benzyl-dU
  modified_base (28)..(28): 2'-O-methyl-c
  modified_base (30)..(30): benzyl-dU

SEQ ID NO: 146 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (13)..(13): 2'-fluoro-a
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (24)..(24): 2'-O-methyl-a
  modified_base (27)..(27): benzyl-dU
  modified_base (28)..(28): 2'-O-methyl-c
  modified_base (30)..(30): benzyl-dU

SEQ ID NO: 147 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-fluoro-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (24)..(24): 2'-O-methyl-a
  modified_base (27)..(27): benzyl-dU
  modified_base (28)..(28): 2'-O-methyl-c
  modified_base (30)..(30): benzyl-dU

SEQ ID NO: 148 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (24)..(24): 2'-O-methyl-a
  modified_base (25)..(25): 2'-fluoro-a
  modified_base (27)..(27): benzyl-dU
  modified_base (28)..(28): 2'-O-methyl-c
  modified_base (30)..(30): benzyl-dU

SEQ ID NO: 149 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (18)..(18): 2'-fluoro-c
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (24)..(24): 2'-O-methyl-a
  modified_base (27)..(27): benzyl-dU
  modified_base (28)..(28): 2'-O-methyl-c
  modified_base (30)..(30): benzyl-dU

SEQ ID NO: 150 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (17)..(18): Heg linker between nucleotides
  modified_base (18)..(18): tyrosyl-dU
  modified_base (19)..(19): benzyl-dU
  modified_base (20)..(20): 2'-O-methyl-a
  modified_base (22)..(22): 2'-O-methyl-g
  modified_base (23)..(23): 2'-O-methyl-u
  modified_base (24)..(24): 2'-O-methyl-c
  modified_base (26)..(26): benzyl-dU
ggcagguuugguauuaauuaagucgugg

SEQ ID NO: 151 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (17)..(18): Heg linker between nucleotides
  modified_base (18)..(18): tyrosyl-dU
  modified_base (19)..(19): benzyl-dU
  modified_base (20)..(20): 2'-O-methyl-a
  modified_base (23)..(23): 2'-O-methyl-u
  modified_base (24)..(24): 2'-O-methyl-c
  modified_base (26)..(26): benzyl-dU
  modified_base (28)..(28): 2'-O-methyl-g
ggcagguuugguauuaauuaagucgugg

SEQ ID NO: 152 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  misc_feature (17)..(18): Heg linker between nucleotides
  modified_base (18)..(18): tyrosyl-dU
  modified_base (19)..(19): benzyl-dU
  modified_base (20)..(20): 2'-O-methyl-a
  modified_base (23)..(23): 2'-O-methyl-u
  modified_base (24)..(24): 2'-O-methyl-c
  modified_base (26)..(26): benzyl-dU
ggcagguuugguauuaauuaagucgugg

SEQ ID NO: 153 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (17)..(18): Heg linker between nucleotides
  modified_base (18)..(18): tyrosyl-dU
  modified_base (19)..(19): benzyl-dU
  modified_base (20)..(20): 2'-O-methyl-a
  modified_base (21)..(21): 2'-O-methyl-a
  modified_base (23)..(23): 2'-O-methyl-u
  modified_base (24)..(24): 2'-O-methyl-c
  modified_base (26)..(26): benzyl-dU
ggcagguuugguauuaauuaagucgugg

SEQ ID NO: 154 - DNA, 31 bp, Artificial Sequence; identical to SEQ ID NO: 104
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (24)..(24): 2'-O-methyl-a
  modified_base (26)..(26): 2'-O-methyl-g
  modified_base (27)..(27): 2'-O-methyl-u
  misc_feature (27)..(28): C3 linker between nucleotides
  modified_base (29)..(29): benzyl-dU

SEQ ID NO: 155 - DNA, 31 bp, Artificial Sequence; identical to SEQ ID NO: 104
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (24)..(24): 2'-O-methyl-a
  modified_base (27)..(27): 2'-O-methyl-u
  misc_feature (27)..(28): C3 linker between nucleotides
  modified_base (29)..(29): benzyl-dU
  modified_base (31)..(31): 2'-O-methyl-g

SEQ ID NO: 156 - DNA, 31 bp, Artificial Sequence; identical to SEQ ID NO: 104
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (24)..(24): 2'-O-methyl-a
  modified_base (27)..(27): 2'-O-methyl-u
  misc_feature (27)..(28): C3 linker between nucleotides
  modified_base (29)..(29): benzyl-dU

SEQ ID NO: 157 - DNA, 31 bp, Artificial Sequence; identical to SEQ ID NO: 104
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (24)..(24): 2'-O-methyl-a
  modified_base (25)..(25): 2'-O-methyl-a
  modified_base (27)..(27): 2'-O-methyl-u
  misc_feature (27)..(28): C3 linker between nucleotides
  modified_base (29)..(29): benzyl-dU

SEQ ID NO: 158 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (17)..(18): Heg linker between nucleotides
  modified_base (18)..(18): benzyl-dU
  modified_base (19)..(19): benzyl-dU
  modified_base (20)..(20): 2'-O-methyl-a
  modified_base (23)..(23): benzyl-dU
  modified_base (24)..(24): 2'-O-methyl-c
  modified_base (26)..(26): benzyl-dU
ggcagguuugguauuaauuaagucgugg

SEQ ID NO: 159 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (17)..(18): Heg linker between nucleotides
  modified_base (18)..(18): tyrosyl-dU
  modified_base (19)..(19): tyrosyl-dU
  modified_base (20)..(20): 2'-O-methyl-a
  modified_base (23)..(23): 2'-O-methyl-u
  modified_base (24)..(24): 2'-O-methyl-c
  modified_base (26)..(26): benzyl-dU
ggcagguuugguauuaauuaagucgugg

SEQ ID NO: 160 - DNA, 27 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (17)..(18): Heg linker between nucleotides
  modified_base (18)..(18): tyrosyl-dU
  modified_base (19)..(19): benzyl-dU
  modified_base (20)..(20): 2'-O-methyl-a
  modified_base (23)..(23): 2'-O-methyl-u
  misc_feature (23)..(24): C3 linker between nucleotides
  modified_base (25)..(25): benzyl-dU
ggcagguuugguauuaauuaagugugg

SEQ ID NO: 161 - DNA, 27 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (17)..(18): Heg linker between nucleotides
  modified_base (18)..(18): tyrosyl-dU
  modified_base (19)..(19): benzyl-dU
  modified_base (20)..(20): 2'-O-methyl-a
  modified_base (23)..(23): 2'-O-methyl-u
  misc_feature (23)..(24): C3 linker between nucleotides
  modified_base (25)..(25): tyrosyl-dU
ggcagguuugguauuaauuaagugugg

SEQ ID NO: 162 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  misc_feature (17)..(18): Heg linker between nucleotides
  modified_base (18)..(18): tyrosyl-dU
  modified_base (19)..(19): benzyl-dU
  modified_base (20)..(20): 2'-O-methyl-a
  modified_base (22)..(22): 2'-O-methyl-g
  modified_base (23)..(23): 2'-O-methyl-u
  modified_base (24)..(24): 2'-O-methyl-c
  modified_base (26)..(26): benzyl-dU
  modified_base (28)..(28): 2'-O-methyl-g
ggcagguuugguauuaauuaagucgugg

SEQ ID NO: 163 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  misc_feature (17)..(18): Heg linker between nucleotides
  modified_base (18)..(18): tyrosyl-dU
  modified_base (19)..(19): benzyl-dU
  modified_base (20)..(20): 2'-O-methyl-a
  modified_base (22)..(22): 2'-O-methyl-g
  modified_base (23)..(23): 2'-O-methyl-u
  modified_base (24)..(24): 2'-O-methyl-c
  modified_base (26)..(26): tyrosyl-dU
  modified_base (28)..(28): 2'-O-methyl-g
ggcagguuugguauuaauuaagucgugg

SEQ ID NO: 164 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  misc_feature (17)..(18): Heg linker between nucleotides
  modified_base (18)..(18): tyrosyl-dU
  modified_base (19)..(19): tyrosyl-dU
  modified_base (20)..(20): 2'-O-methyl-a
  modified_base (22)..(22): 2'-O-methyl-g
  modified_base (23)..(23): 2'-O-methyl-u
  modified_base (24)..(24): 2'-O-methyl-c
  modified_base (26)..(26): benzyl-dU
  modified_base (28)..(28): 2'-O-methyl-g
ggcagguuugguauuaauuaagucgugg

SEQ ID NO: 165 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): tyrosyl-dU
  modified_base (16)..(16): 2'-O-methyl-a
  modified_base (17)..(17): 2'-O-methyl-a
  misc_feature (17)..(18): Heg linker between nucleotides
  modified_base (18)..(18): tyrosyl-dU
  modified_base (19)..(19): benzyl-dU
  modified_base (20)..(20): 2'-O-methyl-a
  modified_base (22)..(22): 2'-O-methyl-g
  modified_base (23)..(23): 2'-O-methyl-u
  modified_base (24)..(24): 2'-O-methyl-c
  modified_base (26)..(26): tyrosyl-dU
  modified_base (28)..(28): 2'-O-methyl-g
ggcagguuugguauuaauuaagucgugg

SEQ ID NO: 166 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  misc_feature (17)..(18): Heg linker between nucleotides
  modified_base (18)..(18): tyrosyl-dU
  modified_base (19)..(19): benzyl-dU
  modified_base (20)..(20): 2'-O-methyl-a
  modified_base (21)..(21): 2'-fluoro-a
  modified_base (22)..(22): 2'-O-methyl-g
  modified_base (23)..(23): 2'-O-methyl-u
  modified_base (24)..(24): 2'-O-methyl-c
  modified_base (26)..(26): benzyl-dU
  modified_base (28)..(28): 2'-O-methyl-g
ggcagguuugguauuaauuaagucgugg

SEQ ID NO: 167 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): tyrosyl-dU
  modified_base (16)..(16): 2'-O-methyl-a
  modified_base (17)..(17): 2'-O-methyl-a
  misc_feature (17)..(18): Heg linker between nucleotides
  modified_base (18)..(18): tyrosyl-dU
  modified_base (19)..(19): benzyl-dU
  modified_base (20)..(20): 2'-O-methyl-a
  modified_base (21)..(21): 2'-fluoro-a
  modified_base (22)..(22): 2'-O-methyl-g
  modified_base (23)..(23): 2'-O-methyl-u
  modified_base (24)..(24): 2'-O-methyl-c
  modified_base (26)..(26): tyrosyl-dU
  modified_base (28)..(28): 2'-O-methyl-g
ggcagguuugguauuaauuaagucgugg

SEQ ID NO: 168 - DNA, 31 bp, Artificial Sequence; identical to SEQ ID NO: 104
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): tyrosyl-dU
  modified_base (23)..(23): benzyl-dU
  modified_base (24)..(24): 2'-O-methyl-a
  modified_base (27)..(27): 2'-O-methyl-u
  misc_feature (27)..(28): C3 linker between nucleotides
  modified_base (29)..(29): benzyl-dU

SEQ ID NO: 169 - DNA, 31 bp, Artificial Sequence; identical to SEQ ID NO: 104
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): tyrosyl-dU
  modified_base (23)..(23): benzyl-dU
  modified_base (24)..(24): 2'-O-methyl-a
  modified_base (27)..(27): 2'-O-methyl-u
  misc_feature (27)..(28): C3 linker between nucleotides
  modified_base (29)..(29): tyrosyl-dU

SEQ ID NO: 170 - DNA, 31 bp, Artificial Sequence; identical to SEQ ID NO: 104
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (24)..(24): 2'-O-methyl-a
  modified_base (26)..(26): 2'-O-methyl-g
  modified_base (27)..(27): 2'-O-methyl-u
  misc_feature (27)..(28): C3 linker between nucleotides
  modified_base (29)..(29): benzyl-dU
  modified_base (31)..(31): 2'-O-methyl-g

SEQ ID NO: 171 - DNA, 31 bp, Artificial Sequence; identical to SEQ ID NO: 104
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (19)..(19): 2'-O-methyl-a
  modified_base (20)..(20): 2'-O-methyl-c
  modified_base (22)..(22): tyrosyl-dU
  modified_base (23)..(23): benzyl-dU
  modified_base (24)..(24): 2'-O-methyl-a
  modified_base (26)..(26): 2'-O-methyl-g
  modified_base (27)..(27): 2'-O-methyl-u
  misc_feature (27)..(28): C3 linker between nucleotides
  modified_base (29)..(29): benzyl-dU
  modified_base (31)..(31): 2'-O-methyl-g

SEQ ID NO: 172 - DNA, 31 bp, Artificial Sequence; identical to SEQ ID NO: 104
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): tyrosyl-dU
  modified_base (24)..(24): 2'-O-methyl-a
  modified_base (26)..(26): 2'-O-methyl-g
  modified_base (27)..(27): 2'-O-methyl-u
  misc_feature (27)..(28): C3 linker between nucleotides
  modified_base (29)..(29): benzyl-dU
  modified_base (31)..(31): 2'-O-methyl-g

SEQ ID NO: 173 - DNA, 31 bp, Artificial Sequence; identical to SEQ ID NO: 104
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (19)..(19): 2'-O-methyl-a
  modified_base (20)..(20): 2'-O-methyl-c
  modified_base (22)..(22): tyrosyl-dU
  modified_base (23)..(23): tyrosyl-dU
  modified_base (24)..(24): 2'-O-methyl-a
  modified_base (26)..(26): 2'-O-methyl-g
  modified_base (27)..(27): 2'-O-methyl-u
  misc_feature (27)..(28): C3 linker between nucleotides
  modified_base (29)..(29): benzyl-dU
  modified_base (31)..(31): 2'-O-methyl-g

SEQ ID NO: 174 - DNA, 31 bp, Artificial Sequence; identical to SEQ ID NO: 104
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): tyrosyl-dU
  modified_base (16)..(16): 2'-O-methyl-a
  modified_base (17)..(17): 2'-O-methyl-a
  modified_base (19)..(19): 2'-O-methyl-a
  modified_base (20)..(20): 2'-O-methyl-c
  modified_base (22)..(22): tyrosyl-dU
  modified_base (23)..(23): benzyl-dU
  modified_base (24)..(24): 2'-O-methyl-a
  modified_base (26)..(26): 2'-O-methyl-g
  modified_base (27)..(27): 2'-O-methyl-u
  misc_feature (27)..(28): C3 linker between nucleotides
  modified_base (29)..(29): tyrosyl-dU
  modified_base (31)..(31): 2'-O-methyl-g

SEQ ID NO: 175 - DNA, 31 bp, Artificial Sequence; identical to SEQ ID NO: 104
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (24)..(24): 2'-O-methyl-a
  modified_base (25)..(25): 2'-fluoro-a
  modified_base (26)..(26): 2'-O-methyl-g
  modified_base (27)..(27): 2'-O-methyl-u
  misc_feature (27)..(28): C3 linker between nucleotides
  modified_base (29)..(29): benzyl-dU
  modified_base (31)..(31): 2'-O-methyl-g

SEQ ID NO: 176 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): tyrosyl-dU
  modified_base (21)..(21): benzyl-dU
  modified_base (22)..(22): 2'-O-methyl-a
  modified_base (25)..(25): 2'-O-methyl-u
  modified_base (26)..(26): 2'-O-methyl-c
  modified_base (28)..(28): benzyl-dU

SEQ ID NO: 177 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (18)..(18): 2'-O-methyl-c
  misc_feature (18)..(19): Heg linker between nucleotides
  modified_base (20)..(20): benzyl-dU
  modified_base (21)..(21): benzyl-dU
  modified_base (22)..(22): 2'-O-methyl-a
  modified_base (25)..(25): 2'-O-methyl-u
  modified_base (26)..(26): 2'-O-methyl-c
  modified_base (28)..(28): benzyl-dU

SEQ ID NO: 178 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (18)..(19): Heg linker between nucleotides
  modified_base (19)..(19): 2'-O-methyl-g
  modified_base (20)..(20): benzyl-dU
  modified_base (21)..(21): benzyl-dU
  modified_base (22)..(22): 2'-O-methyl-a
  modified_base (25)..(25): 2'-O-methyl-u
  modified_base (26)..(26): 2'-O-methyl-c
  modified_base (28)..(28): benzyl-dU

SEQ ID NO: 179 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): benzyl-dU
  modified_base (21)..(21): benzyl-dU
  modified_base (22)..(22): 2'-O-methyl-a
  modified_base (25)..(25): 2'-O-methyl-u
  modified_base (26)..(26): 2'-O-methyl-c
  modified_base (28)..(28): benzyl-dU

SEQ ID NO: 180 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): benzyl-dU
  modified_base (21)..(21): benzyl-dU
  modified_base (22)..(22): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (28)..(28): benzyl-dU
  modified_base (30)..(30): 2'-O-methyl-g

SEQ ID NO: 181 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): benzyl-dU
  modified_base (21)..(21): benzyl-dU
  modified_base (22)..(22): 2'-O-methyl-a
  modified_base (23)..(23): 2'-fluoro-a
  modified_base (24)..(24): 2'-O-methyl-g
  modified_base (25)..(25): 2'-O-methyl-u
  modified_base (26)..(26): 2'-O-methyl-c
  modified_base (28)..(28): benzyl-dU
  modified_base (30)..(30): 2'-O-methyl-g

SEQ ID NO: 182 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (18)..(18): 2'-O-methyl-c
  misc_feature (18)..(19): Heg linker between nucleotides
  modified_base (20)..(20): tyrosyl-dU
  modified_base (21)..(21): benzyl-dU
  modified_base (22)..(22): 2'-O-methyl-a
  modified_base (25)..(25): 2'-O-methyl-u
  modified_base (26)..(26): 2'-O-methyl-c
  modified_base (28)..(28): benzyl-dU

SEQ ID NO: 183 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (18)..(19): Heg linker between nucleotides
  modified_base (19)..(19): 2'-O-methyl-g
  modified_base (20)..(20): tyrosyl-dU
  modified_base (21)..(21): benzyl-dU
  modified_base (22)..(22): 2'-O-methyl-a
  modified_base (25)..(25): 2'-O-methyl-u
  modified_base (26)..(26): 2'-O-methyl-c
  modified_base (28)..(28): benzyl-dU

SEQ ID NO: 184 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): tyrosyl-dU
  modified_base (21)..(21): benzyl-dU
  modified_base (22)..(22): 2'-O-methyl-a
  modified_base (25)..(25): 2'-O-methyl-u
  modified_base (26)..(26): 2'-O-methyl-c
  modified_base (28)..(28): benzyl-dU

SEQ ID NO: 185 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): tyrosyl-dU
  modified_base (21)..(21): benzyl-dU
  modified_base (22)..(22): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (28)..(28): benzyl-dU
  modified_base (30)..(30): 2'-O-methyl-g

SEQ ID NO: 186 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): tyrosyl-dU
  modified_base (21)..(21): benzyl-dU
  modified_base (22)..(22): 2'-O-methyl-a
  modified_base (23)..(23): 2'-fluoro-a
  modified_base (24)..(24): 2'-O-methyl-g
  modified_base (25)..(25): 2'-O-methyl-u
  modified_base (26)..(26): 2'-O-methyl-c
  modified_base (28)..(28): benzyl-dU
  modified_base (30)..(30): 2'-O-methyl-g

SEQ ID NO: 187 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-fluoro-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (24)..(24): 2'-O-methyl-a
  modified_base (25)..(25): 2'-fluoro-a
  modified_base (26)..(26): 2'-O-methyl-g
  modified_base (27)..(27): 2'-O-methyl-u
  modified_base (28)..(28): 2'-O-methyl-c
  modified_base (30)..(30): benzyl-dU
  modified_base (32)..(32): 2'-O-methyl-g

SEQ ID NO: 188 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-fluoro-a
  misc_feature (18)..(19): Heg linker between nucleotides
  modified_base (20)..(20): benzyl-dU
  modified_base (21)..(21): benzyl-dU
  modified_base (22)..(22): 2'-O-methyl-a
  modified_base (23)..(23): 2'-fluoro-a
  modified_base (24)..(24): 2'-O-methyl-g
  modified_base (25)..(25): 2'-O-methyl-u
  modified_base (26)..(26): 2'-O-methyl-c
  modified_base (28)..(28): benzyl-dU
  modified_base (30)..(30): 2'-O-methyl-g

SEQ ID NO: 189 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (18)..(18): 2'-O-methyl-c
  misc_feature (18)..(19): Heg linker between nucleotides
  modified_base (19)..(19): 2'-fluoro-g
  modified_base (20)..(20): benzyl-dU
  modified_base (21)..(21): benzyl-dU
  modified_base (22)..(22): 2'-O-methyl-a
  modified_base (25)..(25): 2'-O-methyl-u
  modified_base (26)..(26): 2'-O-methyl-c
  modified_base (28)..(28): benzyl-dU

SEQ ID NO: 190 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): benzyl-dU
  modified_base (21)..(21): benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (28)..(28): benzyl-dU
  modified_base (30)..(30): 2'-O-methyl-g

SEQ ID NO: 191 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): tyrosyl-dU
  modified_base (21)..(21): benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (28)..(28): benzyl-dU
  modified_base (30)..(30): 2'-O-methyl-g

SEQ ID NO: 192 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (17)..(18): Heg linker between nucleotides
  modified_base (18)..(18): tyrosyl-dU
  modified_base (19)..(19): benzyl-dU
  modified_base (20)..(20): 2'-O-methyl-a
  modified_base (23)..(23): 2'-O-methyl-u
  modified_base (24)..(24): 2'-O-methyl-c
  modified_base (25)..(25): phosphorothioate-(deoxyribose)-g
  modified_base (26)..(26): benzyl-dU
ggcagguuugguauuaauuaagucgugg

SEQ ID NO: 193 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (17)..(18): Heg linker between nucleotides
  modified_base (18)..(18): tyrosyl-dU
  modified_base (19)..(19): benzyl-dU
  modified_base (20)..(20): 2'-O-methyl-a
  modified_base (23)..(23): 2'-O-methyl-u
  modified_base (24)..(24): 2'-O-methyl-c
  modified_base (26)..(26): benzyl-dU
  modified_base (28)..(28): phosphorothioate-(deoxyribose)-g
ggcagguuugguauuaauuaagucgugg

SEQ ID NO: 194 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (17)..(18): Heg linker between nucleotides
  modified_base (18)..(18): tyrosyl-dU
  modified_base (19)..(19): benzyl-dU
  modified_base (20)..(20): 2'-O-methyl-a
  modified_base (23)..(23): 2'-O-methyl-u
  modified_base (24)..(24): 2'-O-methyl-c
  modified_base (26)..(26): phosphorothioate-(deoxyribose)-benzyl-dU
ggcagguuugguauuaauuaagucgugg

SEQ ID NO: 195 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-benzyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (18)..(18): 2'-O-methyl-c
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (24)..(24): 2'-O-methyl-a
  modified_base (27)..(27): benzyl-dU
  modified_base (28)..(28): 2'-O-methyl-c
  modified_base (30)..(30): benzyl-dU

SEQ ID NO: 196 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): 2'-O-methyl-benzyl-dU
  modified_base (16)..(16): 2'-O-methyl-a
  modified_base (17)..(17): 2'-O-methyl-a
  misc_feature (17)..(18): Heg linker between nucleotides
  modified_base (18)..(18): 2'-O-methyl-benzyl-dU
  modified_base (19)..(19): 2'-O-methyl-benzyl-dU
  modified_base (20)..(20): 2'-O-methyl-a
  modified_base (21)..(21): 2'-O-methyl-a
  modified_base (22)..(22): 2'-O-methyl-g
  modified_base (23)..(23): 2'-O-methyl-u
  modified_base (24)..(24): 2'-O-methyl-c
  modified_base (26)..(26): benzyl-dU
  modified_base (28)..(28): 2'-O-methyl-g
ggcagguuugguauuaauuaagucgugg

SEQ ID NO: 197 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): 2'-O-methyl-benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  misc_feature (17)..(18): Heg linker between nucleotides
  modified_base (18)..(18): 2'-O-methyl-benzyl-dU
  modified_base (19)..(19): 2'-O-methyl-benzyl-dU
  modified_base (20)..(20): 2'-O-methyl-a
  modified_base (21)..(21): 2'-O-methyl-a
  modified_base (22)..(22): 2'-O-methyl-g
  modified_base (23)..(23): 2'-O-methyl-u
  modified_base (24)..(24): 2'-O-methyl-c
  modified_base (26)..(26): benzyl-dU
  modified_base (28)..(28): 2'-O-methyl-g
ggcagguuugguauuaauuaagucgugg

SEQ ID NO: 198 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): 2'-O-methyl-benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): 2'-O-methyl-benzyl-dU
  modified_base (16)..(16): 2'-O-methyl-a
  modified_base (17)..(17): 2'-O-methyl-a
  misc_feature (17)..(18): Heg linker between nucleotides
  modified_base (18)..(18): benzyl-dU
  modified_base (19)..(19): 2'-O-methyl-benzyl-dU
  modified_base (20)..(20): 2'-O-methyl-a
  modified_base (21)..(21): 2'-O-methyl-a
  modified_base (22)..(22): 2'-O-methyl-g
  modified_base (23)..(23): 2'-O-methyl-u
  modified_base (24)..(24): 2'-O-methyl-c
  modified_base (26)..(26): benzyl-dU
  modified_base (28)..(28): 2'-O-methyl-g
ggcagguuugguauuaauuaagucgugg

SEQ ID NO: 199 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): 2'-O-methyl-benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): 2'-O-methyl-benzyl-dU
  modified_base (16)..(16): 2'-O-methyl-a
  modified_base (17)..(17): 2'-O-methyl-a
  misc_feature (17)..(18): Heg linker between nucleotides
  modified_base (18)..(18): 2'-O-methyl-benzyl-dU
  modified_base (19)..(19): benzyl-dU
  modified_base (20)..(20): 2'-O-methyl-a
  modified_base (21)..(21): 2'-O-methyl-a
  modified_base (22)..(22): 2'-O-methyl-g
  modified_base (23)..(23): 2'-O-methyl-u
  modified_base (24)..(24): 2'-O-methyl-c
  modified_base (26)..(26): benzyl-dU
  modified_base (28)..(28): 2'-O-methyl-g
ggcagguuugguauuaauuaagucgugg

SEQ ID NO: 200 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): 2'-O-methyl-benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): 2'-O-methyl-benzyl-dU
  modified_base (16)..(16): 2'-O-methyl-a
  modified_base (17)..(17): 2'-O-methyl-a
  misc_feature (17)..(18): Heg linker between nucleotides
  modified_base (18)..(18): 2'-O-methyl-benzyl-dU
  modified_base (19)..(19): 2'-O-methyl-benzyl-dU
  modified_base (20)..(20): 2'-O-methyl-a
  modified_base (21)..(21): 2'-O-methyl-a
  modified_base (22)..(22): 2'-O-methyl-g
  modified_base (23)..(23): 2'-O-methyl-u
  modified_base (24)..(24): 2'-O-methyl-c
  modified_base (26)..(26): benzyl-dU
  modified_base (28)..(28): 2'-O-methyl-g
ggcagguuugguauuaauuaagucgugg

SEQ ID NO: 201 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): 2'-O-methyl-benzyl-dU
  modified_base (8)..(8): benzyl-dU
  modified_base (9)..(9): 2'-O-methyl-benzyl-dU
  modified_base (12)..(12): naphthyl-dU
  modified_base (14)..(14): benzyl-dU
  modified_base (15)..(15): 2'-O-methyl-benzyl-dU
  modified_base (16)..(16): 2'-O-methyl-a
  modified_base (17)..(17): 2'-O-methyl-a
  misc_feature (17)..(18): Heg linker between nucleotides
  modified_base (18)..(18): 2'-O-methyl-benzyl-dU
  modified_base (19)..(19): 2'-O-methyl-benzyl-dU
  modified_base (20)..(20): 2'-O-methyl-a
  modified_base (21)..(21): 2'-O-methyl-a
  modified_base (22)..(22): 2'-O-methyl-g
  modified_base (23)..(23): 2'-O-methyl-u
  modified_base (24)..(24): 2'-O-methyl-c
  modified_base (26)..(26): benzyl-dU
  modified_base (28)..(28): 2'-O-methyl-g
ggcagguuugguauuaauuaagucgugg

SEQ ID NO: 202 - DNA, 28 bp, Artificial Sequence
  Description of Artificial Sequence: Synthetic oligonucleotide
  Description of Combined DNA/RNA Molecule: Synthetic oligonucleotide
  modified_base (1)..(1): phosphorothioate-(deoxyribose)-g
  modified_base (2)..(2): phosphorothioate-(deoxyribose)-g
  modified_base (3)..(3): 2'-O-methyl-c
  modified_base (4)..(4): 2'-O-methyl-a
  modified_base (5)..(5): phosphorothioate-(deoxyribose)-g
  modified_base (6)..(6): 2'-O-methyl-g
  modified_base (7)..(7): phosphorothioate-(deoxyribose)-benzyl-dU
  modified_base (8)..(8): phosphorothioate-(deoxyribose)-benzyl-dU
  modified_base (9)..(9): phosphorothioate-(deoxyribose)-benzyl-dU
  modified_base (11)..(11): phosphorothioate-(deoxyribose)-g
  modified_base (12)..(12): phosphorothioate-(deoxyribose)-naphthyl-dU
  modified_base (13)..(13): phosphorothioate-(deoxyribose)-a
  modified_base (14)..(14): phosphorothioate-(deoxyribose)-benzyl-dU
  modified_base (15)..(15): phosphorothioate-(deoxyribose)-benzyl-dU
  modified_base (16)..(16): 2'-O-methyl-a
  modified_base (17)..(17): 2'-O-methyl-a
  misc_feature (17)..(18): phosphorothioate-Heg linker between nucleotides
  modified_base (18)..(18): phosphorothioate-(deoxyribose)-benzyl-dU
  modified_base (19)..(19): 2'-O-methyl-benzyl-dU
  modified_base (20)..(20): 2'-O-methyl-a
  modified_base (21)..(21): 2'-O-methyl-a
  modified_base (22)..(22): 2'-O-methyl-g
  modified_base (23)..(23): 2'-O-methyl-u
  modified_base (24)..(24): 2'-O-methyl-c
  modified_base (25)..(25): phosphorothioate-(deoxyribose)-g
  modified_base (26)..(26): phosphorothioate-(deoxyribose)-benzyl-dU
  modified_base (27)..(27): phosphorothioate-(deoxyribose)-g
  modified_base (28)..(28): 2'-O-methyl-g
ggcagguuugguauuaauuaagucgugg

SEQ ID NO: 203 - DNA, 28 bp, Artificial Sequence
  Description of Artificial Sequence: Synthetic oligonucleotide
  Description of Combined DNA/RNA Molecule: Synthetic oligonucleotide
  modified_base (1)..(1): phosphorothioate-(deoxyribose)-g
  modified_base (2)..(2): phosphorothioate-(deoxyribose)-g
  modified_base (3)..(3): 2'-O-methyl-c
  modified_base (4)..(4): 2'-O-methyl-a
  modified_base (5)..(5): phosphorothioate-(deoxyribose)-g
  modified_base (6)..(6): 2'-O-methyl-g
  modified_base (7)..(7): phosphorothioate-(deoxyribose)-benzyl-dU
  modified_base (8)..(8): phosphorothioate-(deoxyribose)-benzyl-dU
  modified_base (9)..(9): phosphorothioate-(deoxyribose)-benzyl-dU
  modified_base (10)..(10): phosphorothioate-(deoxyribose)-g
  modified_base (11)..(11): phosphorothioate-(deoxyribose)-g
  modified_base (12)..(12): phosphorothioate-(deoxyribose)-naphthyl-dU
  modified_base (13)..(13): phosphorothioate-(deoxyribose)-a
  modified_base (14)..(14): phosphorothioate-(deoxyribose)-benzyl-dU
  modified_base (15)..(15): phosphorothioate-(deoxyribose)-benzyl-dU
  modified_base (16)..(16): 2'-O-methyl-a
  modified_base (17)..(17): 2'-O-methyl-a
  misc_feature (17)..(18): phosphorothioate-Heg linker between nucleotides
  modified_base (18)..(18): phosphorothioate-(deoxyribose)-benzyl-dU
  modified_base (19)..(19): 2'-O-methyl-benzyl-dU
  modified_base (20)..(20): 2'-O-methyl-a
  modified_base (21)..(21): 2'-O-methyl-a
  modified_base (22)..(22): 2'-O-methyl-g
  modified_base (23)..(23): 2'-O-methyl-u
  modified_base (24)..(24): 2'-O-methyl-c
  modified_base (25)..(25): phosphorothioate-(deoxyribose)-g
  modified_base (26)..(26): phosphorothioate-(deoxyribose)-benzyl-dU
  modified_base (27)..(27): phosphorothioate-(deoxyribose)-g
  modified_base (28)..(28): 2'-O-methyl-g
ggcagguuugguauuaauuaagucgugg

SEQ ID NO: 204 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): 2'-O-methyl-benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): 2'-O-methyl-benzyl-dU
  modified_base (21)..(21): 2'-O-methyl-benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (28)..(28): benzyl-dU
  modified_base (30)..(30): 2'-O-methyl-g

SEQ ID NO: 205 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): 2'-O-methyl-benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): 2'-O-methyl-benzyl-dU
  modified_base (21)..(21): 2'-O-methyl-benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (28)..(28): benzyl-dU
  modified_base (30)..(30): 2'-O-methyl-g

SEQ ID NO: 206 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): 2'-O-methyl-benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): 2'-O-methyl-benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): benzyl-dU
  modified_base (21)..(21): 2'-O-methyl-benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (28)..(28): benzyl-dU
  modified_base (30)..(30): 2'-O-methyl-g

SEQ ID NO: 207 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): 2'-O-methyl-benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): 2'-O-methyl-benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): 2'-O-methyl-benzyl-dU
  modified_base (21)..(21): benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (28)..(28): benzyl-dU
  modified_base (30)..(30): 2'-O-methyl-g

SEQ ID NO: 208 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): 2'-O-methyl-benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): 2'-O-methyl-benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): 2'-O-methyl-benzyl-dU
  modified_base (21)..(21): 2'-O-methyl-benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (28)..(28): benzyl-dU
  modified_base (30)..(30): 2'-O-methyl-g

SEQ ID NO: 209 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): 2'-O-methyl-benzyl-dU
  modified_base (8)..(8): benzyl-dU
  modified_base (9)..(9): 2'-O-methyl-benzyl-dU
  modified_base (12)..(12): naphthyl-dU
  modified_base (14)..(14): benzyl-dU
  modified_base (15)..(15): 2'-O-methyl-benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): 2'-O-methyl-benzyl-dU
  modified_base (21)..(21): 2'-O-methyl-benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (28)..(28): benzyl-dU
  modified_base (30)..(30): 2'-O-methyl-g

SEQ ID NO: 210 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (1)..(1): phosphorothioate-(deoxyribose)-g
  modified_base (2)..(2): phosphorothioate-(deoxyribose)-g
  modified_base (3)..(3): 2'-O-methyl-c
  modified_base (4)..(4): 2'-O-methyl-a
  modified_base (5)..(5): phosphorothioate-(deoxyribose)-g
  modified_base (6)..(6): 2'-O-methyl-g
  modified_base (7)..(7): phosphorothioate-(deoxyribose)-benzyl-dU
  modified_base (8)..(8): phosphorothioate-(deoxyribose)-benzyl-dU
  modified_base (9)..(9): phosphorothioate-(deoxyribose)-benzyl-dU
  modified_base (11)..(11): phosphorothioate-(deoxyribose)-g
  modified_base (12)..(12): phosphorothioate-(deoxyribose)-naphthyl-dU
  modified_base (13)..(13): phosphorothioate-(deoxyribose)-a
  modified_base (14)..(14): phosphorothioate-(deoxyribose)-benzyl-dU
  modified_base (15)..(15): phosphorothioate-(deoxyribose)-benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): phosphorothioate-Heg linker between nucleotides
  modified_base (19)..(19): 2'-O-methyl-g
  modified_base (20)..(20): phosphorothioate-(deoxyribose)-benzyl-dU
  modified_base (21)..(21): 2'-O-methyl-benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (27)..(27): phosphorothioate-(deoxyribose)-g
  modified_base (28)..(28): phosphorothioate-(deoxyribose)-benzyl-dU
  modified_base (29)..(29): phosphorothioate-(deoxyribose)-g
  modified_base (30)..(30): 2'-O-methyl-g

SEQ ID NO: 211 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (1)..(1): phosphorothioate-(deoxyribose)-g
  modified_base (2)..(2): phosphorothioate-(deoxyribose)-g
  modified_base (3)..(3): 2'-O-methyl-c
  modified_base (4)..(4): 2'-O-methyl-a
  modified_base (5)..(5): phosphorothioate-(deoxyribose)-g
  modified_base (6)..(6): 2'-O-methyl-g
  modified_base (7)..(7): phosphorothioate-(deoxyribose)-benzyl-dU
  modified_base (8)..(8): phosphorothioate-(deoxyribose)-benzyl-dU
  modified_base (9)..(9): phosphorothioate-(deoxyribose)-benzyl-dU
  modified_base (10)..(10): phosphorothioate-(deoxyribose)-g
  modified_base (11)..(11): phosphorothioate-(deoxyribose)-g
  modified_base (12)..(12): phosphorothioate-(deoxyribose)-naphthyl-dU
  modified_base (13)..(13): phosphorothioate-(deoxyribose)-a
  modified_base (14)..(14): phosphorothioate-(deoxyribose)-benzyl-dU
  modified_base (15)..(15): phosphorothioate-(deoxyribose)-benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): phosphorothioate-Heg linker between nucleotides
  modified_base (19)..(19): 2'-O-methyl-g
  modified_base (20)..(20): phosphorothioate-(deoxyribose)-benzyl-dU
  modified_base (21)..(21): 2'-O-methyl-benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (27)..(27): phosphorothioate-(deoxyribose)-g
  modified_base (28)..(28): phosphorothioate-(deoxyribose)-benzyl-dU
  modified_base (29)..(29): phosphorothioate-(deoxyribose)-g
  modified_base (30)..(30): 2'-O-methyl-g

SEQ ID NO: 212 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): 2'-O-methyl-benzyl-dU
  modified_base (8)..(8): benzyl-dU
  modified_base (9)..(9): 2'-O-methyl-benzyl-dU
  modified_base (12)..(12): naphthyl-dU
  modified_base (14)..(14): benzyl-dU
  modified_base (15)..(15): 2'-O-methyl-benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): 2'-O-methyl-u
  modified_base (21)..(21): 2'-O-methyl-benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (28)..(28): benzyl-dU
  modified_base (30)..(30): 2'-O-methyl-g

SEQ ID NO: 213 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): benzyl-dU
  modified_base (21)..(21): benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (28)..(28): benzyl-dU
  modified_base (30)..(30): 2'-O-methyl-g

SEQ ID NO: 214 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): benzyl-dU
  modified_base (21)..(21): benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (28)..(28): phosphorothioate-(deoxyribose)-benzyl-dU
  modified_base (29)..(29): phosphorothioate-(deoxyribose)-g
  modified_base (30)..(30): 2'-O-methyl-g

SEQ ID NO: 215 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): methylenedioxybenzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): benzyl-dU
  modified_base (21)..(21): benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): benzyl-dU
  modified_base (26)..(26): 2'-O-methyl-c
  modified_base (28)..(28): benzyl-dU
  modified_base (30)..(30): 2'-O-methyl-g

SEQ ID NO: 216 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): benzyl-dU
  modified_base (21)..(21): benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): benzyl-dU
  modified_base (26)..(26): 2'-O-methyl-c
  modified_base (28)..(28): isobutyl-dU
  modified_base (30)..(30): 2'-O-methyl-g

SEQ ID NO: 217 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): methylenedioxybenzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): benzyl-dU
  modified_base (21)..(21): benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): benzyl-dU
  modified_base (26)..(26): 2'-O-methyl-c
  modified_base (28)..(28): isobutyl-dU
  modified_base (30)..(30): 2'-O-methyl-g

SEQ ID NO: 218 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (1)..(1): phosphorothioate-(deoxyribose)-g
  modified_base (2)..(2): phosphorothioate-(deoxyribose)-g
  modified_base (3)..(3): 2'-O-methyl-c
  modified_base (4)..(4): 2'-O-methyl-a
  modified_base (5)..(5): phosphorothioate-(deoxyribose)-g
  modified_base (6)..(6): 2'-O-methyl-g
  modified_base (7)..(7): 2'-O-methyl-benzyl-dU
  modified_base (8)..(8): phosphorothioate-(deoxyribose)-benzyl-dU
  modified_base (9)..(9): 2'-O-methyl-u
  modified_base (10)..(10): phosphorothioate-(deoxyribose)-g
  modified_base (11)..(11): phosphorothioate-(deoxyribose)-g
  modified_base (12)..(12): phosphorothioate-(deoxyribose)-naphthyl-dU
  modified_base (13)..(13): phosphorothioate-(deoxyribose)-a
  modified_base (14)..(14): phosphorothioate-(deoxyribose)-benzyl-dU
  modified_base (15)..(15): 2'-O-methyl-benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): 2'-O-methyl-benzyl-dU
  modified_base (21)..(21): 2'-O-methyl-benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (27)..(27): phosphorothioate-(deoxyribose)-g
  modified_base (28)..(28): phosphorothioate-(deoxyribose)-benzyl-dU
  modified_base (29)..(29): phosphorothioate-(deoxyribose)-g
  modified_base (30)..(30): 2'-O-methyl-g

SEQ ID NO: 219 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): 2'-O-methyl-benzyl-dU
  modified_base (8)..(8): phosphorothioate-(deoxyribose)-benzyl-dU
  modified_base (9)..(9): 2'-O-methyl-u
  modified_base (12)..(12): naphthyl-dU
  modified_base (14)..(14): phosphorothioate-(deoxyribose)-benzyl-dU
  modified_base (15)..(15): 2'-O-methyl-benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): 2'-O-methyl-benzyl-dU
  modified_base (21)..(21): 2'-O-methyl-benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (27)..(27): phosphorothioate-(deoxyribose)-g
  modified_base (28)..(28): phosphorothioate-(deoxyribose)-benzyl-dU
  modified_base (29)..(29): phosphorothioate-(deoxyribose)-g
  modified_base (30)..(30): 2'-O-methyl-g

SEQ ID NO: 220 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): benzyl-dU
  modified_base (21)..(21): benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (28)..(28): benzyl-dU
  modified_base (30)..(30): 2'-O-methyl-g

SEQ ID NO: 221 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): methylenedioxybenzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): benzyl-dU
  modified_base (21)..(21): benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (28)..(28): benzyl-dU
  modified_base (30)..(30): 2'-O-methyl-g

SEQ ID NO: 222 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): methylenedioxybenzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): benzyl-dU
  modified_base (21)..(21): benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (27)..(27): phosphorothioate-(deoxyribose)-g
  modified_base (28)..(28): phosphorothioate-(deoxyribose)-benzyl-dU
  modified_base (29)..(29): phosphorothioate-(deoxyribose)-g
  modified_base (30)..(30): 2'-O-methyl-g

SEQ ID NO: 223 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): phosphorothioate-(deoxyribose)-benzyl-dU
  modified_base (9)..(9): 2'-O-methyl-u
  modified_base (12)..(12): naphthyl-dU
  modified_base (14)..(14): benzyl-dU
  modified_base (15)..(15): 2'-O-methyl-benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): 2'-O-methyl-benzyl-dU
  modified_base (24)..(24): 2'-O-methyl-a
  modified_base (27)..(27): benzyl-dU
  modified_base (28)..(28): 2'-O-methyl-c
  modified_base (29)..(29): phosphorothioate-(deoxyribose)-g
  modified_base (30)..(30): phosphorothioate-(deoxyribose)-benzyl-dU
  modified_base (31)..(31): phosphorothioate-(deoxyribose)-g
  modified_base (32)..(32): 2'-O-methyl-g

SEQ ID NO: 224 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phosphorothioate-(deoxyribose)-phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): phosphorothioate-(deoxyribose)-benzyl-dU
  modified_base (27)..(27): benzyl-dU
  modified_base (28)..(28): 2'-O-methyl-c
  modified_base (30)..(30): phosphorothioate-(deoxyribose)-benzyl-dU

SEQ ID NO: 225 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): methylenedioxybenzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): benzyl-dU
  modified_base (21)..(21): benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (28)..(28): phosphorothioate-(deoxyribose)-benzyl-dU
  modified_base (30)..(30): 2'-O-methyl-g

SEQ ID NO: 226 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): methylenedioxybenzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): 2'-O-methyl-benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): benzyl-dU
  modified_base (21)..(21): benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (28)..(28): phosphorothioate-(deoxyribose)-benzyl-dU
  modified_base (30)..(30): 2'-O-methyl-g

SEQ ID NO: 227 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): methylenedioxybenzyl-dU
  modified_base (8)..(8): benzyl-dU
  modified_base (9)..(9): 2'-O-methyl-u
  modified_base (12)..(12): naphthyl-dU
  modified_base (14)..(14): phosphorothioate-(deoxyribose)-benzyl-dU
  modified_base (15)..(15): 2'-O-methyl-benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): benzyl-dU
  modified_base (21)..(21): benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (28)..(28): phosphorothioate-(deoxyribose)-benzyl-dU
  modified_base (30)..(30): 2'-O-methyl-g

SEQ ID NO: 228 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (24)..(24): 2'-O-methyl-a
  modified_base (27)..(27): benzyl-dU
  modified_base (28)..(28): 2'-O-methyl-c
  modified_base (30)..(30): phosphorothioate-(deoxyribose)-benzyl-dU

SEQ ID NO: 229 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): 2'-O-methyl-benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (24)..(24): 2'-O-methyl-a
  modified_base (27)..(27): benzyl-dU
  modified_base (28)..(28): 2'-O-methyl-c
  modified_base (30)..(30): phosphorothioate-(deoxyribose)-benzyl-dU

SEQ ID NO: 230 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): phosphorothioate-(deoxyribose)-benzyl-dU
  modified_base (15)..(15): 2'-O-methyl-benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (24)..(24): 2'-O-methyl-a
  modified_base (27)..(27): benzyl-dU
  modified_base (28)..(28): 2'-O-methyl-c
  modified_base (30)..(30): phosphorothioate-(deoxyribose)-benzyl-dU

SEQ ID NO: 231 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phosphorothioate-(deoxyribose)-phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): phosphorothioate-(deoxyribose)-benzyl-dU
  modified_base (27)..(27): benzyl-dU
  modified_base (28)..(28): 2'-O-methyl-c
  modified_base (29)..(29): phosphorothioate-(deoxyribose)-g
  modified_base (30)..(30): phosphorothioate-(deoxyribose)-benzyl-dU
  modified_base (31)..(31): phosphorothioate-(deoxyribose)-g

SEQ ID NO: 232 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): 2'-O-methyl-methylenedioxybenzyl-dU
  modified_base (8)..(8): phosphorothioate-(deoxyribose)-benzyl-dU
  modified_base (9)..(9): 2'-O-methyl-u
  modified_base (12)..(12): naphthyl-dU
  modified_base (14)..(14): phosphorothioate-(deoxyribose)-benzyl-dU
  modified_base (15)..(15): phosphorothioate-(deoxyribose)-tyrosyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): phosphorothioate-(deoxyribose)-tyrosyl-dU
  modified_base (21)..(21): phosphorothioate-(deoxyribose)-tyrosyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (27)..(27): phosphorothioate-(deoxyribose)-g
  modified_base (28)..(28): phosphorothioate-(deoxyribose)-tyrosyl-dU
  modified_base (29)..(29): phosphorothioate-(deoxyribose)-g
  modified_base (30)..(30): 2'-O-methyl-g

SEQ ID NO: 233 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): 2'-O-methyl-methylenedioxybenzyl-dU
  modified_base (8)..(8): phosphorothioate-(deoxyribose)-benzyl-dU
  modified_base (9)..(9): 2'-O-methyl-u
  modified_base (12)..(12): tyrosyl-dU
  modified_base (14)..(14): phosphorothioate-(deoxyribose)-benzyl-dU
  modified_base (15)..(15): phosphorothioate-(deoxyribose)-tyrosyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): phosphorothioate-(deoxyribose)-tyrosyl-dU
  modified_base (21)..(21): phosphorothioate-(deoxyribose)-tyrosyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (27)..(27): phosphorothioate-(deoxyribose)-g
  modified_base (28)..(28): phosphorothioate-(deoxyribose)-tyrosyl-dU
  modified_base (29)..(29): phosphorothioate-(deoxyribose)-g
  modified_base (30)..(30): 2'-O-methyl-g

SEQ ID NO: 234 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): 2'-O-methyl-methylenedioxybenzyl-dU
  modified_base (8)..(8): phosphorothioate-(deoxyribose)-benzyl-dU
  modified_base (9)..(9): 2'-O-methyl-u
  modified_base (12)..(12): tyrosyl-dU
  modified_base (14)..(14): phosphorothioate-(deoxyribose)-naphthyl-dU
  modified_base (15)..(15): phosphorothioate-(deoxyribose)-tyrosyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): phosphorothioate-(deoxyribose)-tyrosyl-dU
  modified_base (21)..(21): phosphorothioate-(deoxyribose)-tyrosyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (27)..(27): phosphorothioate-(deoxyribose)-g
  modified_base (28)..(28): phosphorothioate-(deoxyribose)-tyrosyl-dU
  modified_base (29)..(29): phosphorothioate-(deoxyribose)-g
  modified_base (30)..(30): 2'-O-methyl-g

SEQ ID NO: 235 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): 2'-O-methyl-methylenedioxybenzyl-dU
  modified_base (8)..(8): phosphorothioate-(deoxyribose)-benzyl-dU
  modified_base (9)..(9): 2'-O-methyl-u
  modified_base (12)..(12): naphthyl-dU
  modified_base (14)..(14): phosphorothioate-(deoxyribose)-naphthyl-dU
  modified_base (15)..(15): phosphorothioate-(deoxyribose)-tyrosyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): phosphorothioate-(deoxyribose)-tyrosyl-dU
  modified_base (21)..(21): phosphorothioate-(deoxyribose)-tyrosyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (27)..(27): phosphorothioate-(deoxyribose)-g
  modified_base (28)..(28): phosphorothioate-(deoxyribose)-tyrosyl-dU
  modified_base (29)..(29): phosphorothioate-(deoxyribose)-g
  modified_base (30)..(30): 2'-O-methyl-g

SEQ ID NO: 236 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): 2'-O-methyl-methylenedioxybenzyl-dU
  modified_base (8)..(8): phosphorothioate-(deoxyribose)-benzyl-dU
  modified_base (9)..(9): 2'-O-methyl-u
  modified_base (12)..(12): naphthyl-dU
  modified_base (14)..(14): phosphorothioate-(deoxyribose)-benzyl-dU
  modified_base (15)..(15): phosphorothioate-(deoxyribose)-tyrosyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): phosphorothioate-(deoxyribose)-tyrosyl-dU
  modified_base (21)..(21): phosphorothioate-(deoxyribose)-tyrosyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (28)..(28): phosphorothioate-(deoxyribose)-tyrosyl-dU
  modified_base (30)..(30): 2'-O-methyl-g

SEQ ID NO: 237 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): 2'-O-methyl-methylenedioxybenzyl-dU
  modified_base (8)..(8): phosphorothioate-(deoxyribose)-benzyl-dU
  modified_base (9)..(9): 2'-O-methyl-u
  modified_base (12)..(12): phosphorothioate-(deoxyribose)-naphthyl-dU
  modified_base (13)..(13): phosphorothioate-(deoxyribose)-a
  modified_base (14)..(14): phosphorothioate-(deoxyribose)-benzyl-dU
  modified_base (15)..(15): 2'-O-methyl-benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): 2'-O-methyl-benzyl-dU
  modified_base (21)..(21): 2'-O-methyl-benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (27)..(27): phosphorothioate-(deoxyribose)-g
  modified_base (28)..(28): phosphorothioate-(deoxyribose)-benzyl-dU
  modified_base (29)..(29): phosphorothioate-(deoxyribose)-g
  modified_base (30)..(30): 2'-O-methyl-g

SEQ ID NO: 238 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): 2'-O-methyl-methylenedioxybenzyl-dU
  modified_base (8)..(8): phosphorothioate-(deoxyribose)-benzyl-dU
  modified_base (9)..(9): 2'-O-methyl-u
  modified_base (12)..(12): phosphorothioate-(deoxyribose)-naphthyl-dU
  modified_base (13)..(13): phosphorothioate-(deoxyribose)-a
  modified_base (14)..(14): phosphorothioate-(deoxyribose)-benzyl-dU
  modified_base (15)..(15): 2'-O-methyl-morpholinoethyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): 2'-O-methyl-morpholinoethyl-dU
  modified_base (21)..(21): 2'-O-methyl-morpholinoethyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (27)..(27): phosphorothioate-(deoxyribose)-g
  modified_base (28)..(28): phosphorothioate-(deoxyribose)-morpholinoethyl-dU
  modified_base (29)..(29): phosphorothioate-(deoxyribose)-g
  modified_base (30)..(30): 2'-O-methyl-g

SEQ ID NO: 239 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): phosphorothioate-(deoxyribose)-a
  modified_base (6)..(6): 2'-O-methyl-g
  modified_base (7)..(7): 2'-O-methyl-methylenedioxybenzyl-dU
  modified_base (8)..(8): phosphorothioate-(deoxyribose)-benzyl-dU
  modified_base (9)..(9): 2'-O-methyl-morpholinoethyl-dU
  modified_base (12)..(12): phosphorothioate-(deoxyribose)-naphthyl-dU
  modified_base (13)..(13): phosphorothioate-(deoxyribose)-a
  modified_base (14)..(14): phosphorothioate-(deoxyribose)-benzyl-dU
  modified_base (15)..(15): 2'-O-methyl-morpholinoethyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): 2'-O-methyl-morpholinoethyl-dU
  modified_base (21)..(21): 2'-O-methyl-morpholinoethyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (27)..(27): phosphorothioate-(deoxyribose)-g
  modified_base (28)..(28): phosphorothioate-(deoxyribose)-morpholinoethyl-dU
  modified_base (29)..(29): phosphorothioate-(deoxyribose)-g
  modified_base (30)..(30): 2'-O-methyl-g

SEQ ID NO: 240-299 - skipped (60 entries)

SEQ ID NO: 300 - DNA, 32 bp, Artificial Sequence
  Description of Artificial Sequence: Synthetic oligonucleotide
ggcaggtttggtattaacacgttaagtcgtgg

SEQ ID NO: 301 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): 2'-O-methyl-u
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (27)..(27): benzyl-dU
  modified_base (28)..(28): 2'-O-methyl-c
  modified_base (30)..(30): benzyl-dU

SEQ ID NO: 302 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (27)..(27): benzyl-dU
  modified_base (28)..(28): 2'-O-methyl-c
  modified_base (30)..(30): 2'-O-methyl-u

SEQ ID NO: 303 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (17)..(18): Heg linker between nucleotides
  modified_base (18)..(18): benzyl-dU
  modified_base (19)..(19): benzyl-dU
  modified_base (20)..(20): 2'-O-methyl-a
  modified_base (23)..(23): benzyl-dU
  modified_base (24)..(24): 2'-O-methyl-c
  modified_base (26)..(26): benzyl-dU
ggcagguuugguauuaauuaagucgugg

SEQ ID NO: 304 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (17)..(18): Heg linker between nucleotides
  modified_base (18)..(18): benzyl-dU
  modified_base (19)..(19): benzyl-dU
  modified_base (20)..(20): 2'-O-methyl-a
  modified_base (23)..(23): 2'-O-methyl-u
  modified_base (24)..(24): 2'-O-methyl-c
  modified_base (26)..(26): benzyl-dU
ggcagguuugguauuaauuaagucgugg

SEQ ID NO: 305 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (17)..(18): Heg linker between nucleotides
  modified_base (18)..(18): tyrosyl-dU
  modified_base (19)..(19): benzyl-dU
  modified_base (20)..(20): 2'-O-methyl-a
  modified_base (23)..(23): benzyl-dU
  modified_base (24)..(24): 2'-O-methyl-c
  modified_base (26)..(26): benzyl-dU
ggcagguuugguauuaauuaagucgugg

SEQ ID NO: 306 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (17)..(18): Heg linker between nucleotides
  modified_base (18)..(18): benzyl-dU
  modified_base (19)..(19): tyrosyl-dU
  modified_base (20)..(20): 2'-O-methyl-a
  modified_base (23)..(23): benzyl-dU
  modified_base (24)..(24): 2'-O-methyl-c
  modified_base (26)..(26): benzyl-dU
ggcagguuugguauuaauuaagucgugg

SEQ ID NO: 307 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (17)..(18): Heg linker between nucleotides
  modified_base (18)..(18): tyrosyl-dU
  modified_base (19)..(19): benzyl-dU
  modified_base (20)..(20): 2'-O-methyl-a
  modified_base (23)..(23): 2'-O-methyl-u
  modified_base (24)..(24): 2'-O-methyl-c
  modified_base (26)..(26): benzyl-dU
ggcagguuugguauuaauuaagucgugg

SEQ ID NO: 308 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (17)..(18): Heg linker between nucleotides
  modified_base (18)..(18): benzyl-dU
  modified_base (19)..(19): tyrosyl-dU
  modified_base (20)..(20): 2'-O-methyl-a
  modified_base (23)..(23): 2'-O-methyl-u
  modified_base (24)..(24): 2'-O-methyl-c
  modified_base (26)..(26): benzyl-dU
ggcagguuugguauuaauuaagucgugg

SEQ ID NO: 309 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (17)..(18): Heg linker between nucleotides
  modified_base (18)..(18): fluorobenzyl-dU
  modified_base (19)..(19): benzyl-dU
  modified_base (20)..(20): 2'-O-methyl-a
  modified_base (23)..(23): benzyl-dU
  modified_base (24)..(24): 2'-O-methyl-c
  modified_base (26)..(26): benzyl-dU
ggcagguuugguauuaauuaagucgugg

SEQ ID NO: 310 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (17)..(18): Heg linker between nucleotides
  modified_base (18)..(18): fluorobenzyl-dU
  modified_base (19)..(19): benzyl-dU
  modified_base (20)..(20): 2'-O-methyl-a
  modified_base (23)..(23): 2'-O-methyl-u
  modified_base (24)..(24): 2'-O-methyl-c
  modified_base (26)..(26): benzyl-dU
ggcagguuugguauuaauuaagucgugg

SEQ ID NO: 311 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (17)..(18): Heg linker between nucleotides
  modified_base (18)..(18): fluorobenzyl-dU
  modified_base (19)..(19): tyrosyl-dU
  modified_base (20)..(20): 2'-O-methyl-a
  modified_base (23)..(23): 2'-O-methyl-u
  modified_base (24)..(24): 2'-O-methyl-c
  modified_base (26)..(26): benzyl-dU
ggcagguuugguauuaauuaagucgugg

SEQ ID NO: 312 - DNA, 27 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (17)..(18): Heg linker between nucleotides
  modified_base (18)..(18): benzyl-dU
  modified_base (19)..(19): benzyl-dU
  modified_base (20)..(20): 2'-O-methyl-a
  modified_base (23)..(23): 2'-O-methyl-u
  misc_feature (23)..(24): C3 linker between nucleotides
  modified_base (25)..(25): benzyl-dU
ggcagguuugguauuaauuaagugugg

SEQ ID NO: 313 - DNA, 26 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (17)..(18): Heg linker between nucleotides
  modified_base (18)..(18): benzyl-dU
  modified_base (19)..(19): benzyl-dU
  modified_base (20)..(20): 2'-O-methyl-a
  misc_feature (22)..(23): Heg linker between nucleotides
  modified_base (24)..(24): benzyl-dU
ggcagguuugguauuaauuaaggugg

SEQ ID NO: 314 - DNA, 26 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (17)..(18): Heg linker between nucleotides
  modified_base (18)..(18): benzyl-dU
  modified_base (19)..(19): benzyl-dU
  modified_base (20)..(20): 2'-O-methyl-a
  misc_feature (22)..(23): Heg linker between nucleotides
  modified_base (24)..(24): benzyl-dU
ggcagguuugguauuaauuaaggugg

SEQ ID NO: 315 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (18)..(19): Heg linker between nucleotides
  modified_base (20)..(20): benzyl-dU
  modified_base (21)..(21): benzyl-dU
  modified_base (22)..(22): 2'-O-methyl-a
  misc_feature (24)..(25): Heg linker between nucleotides
  modified_base (26)..(26): benzyl-dU
ggcagguuugguauuaacguuaaggugg

SEQ ID NO: 316 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (3)..(3): 2'-O-methyl-c
  modified_base (5)..(5): 2'-fluoro-g
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (24)..(24): 2'-O-methyl-a
  modified_base (27)..(27): benzyl-dU
  modified_base (28)..(28): 2'-O-methyl-c
  modified_base (30)..(30): benzyl-dU

SEQ ID NO: 317 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (10)..(10): 2'-fluoro-g
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (24)..(24): 2'-O-methyl-a
  modified_base (27)..(27): benzyl-dU
  modified_base (28)..(28): 2'-O-methyl-c
  modified_base (30)..(30): benzyl-dU

SEQ ID NO: 318 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (24)..(24): 2'-O-methyl-a
  modified_base (27)..(27): benzyl-dU
  modified_base (28)..(28): 2'-O-methyl-c
  modified_base (30)..(30): benzyl-dU
  modified_base (31)..(31): 2'-fluoro-g

SEQ ID NO: 319 - DNA, 16 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  misc_feature (12)..(13): C3 linker between nucleotides
  modified_base (14)..(14): benzyl-dU
ggcagguuuggugugg

SEQ ID NO: 320 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (17)..(18): Heg linker between nucleotides
  modified_base (18)..(18): tyrosyl-dU
  modified_base (19)..(19): benzyl-dU
  modified_base (20)..(20): 2'-O-methyl-a
  modified_base (23)..(23): 2'-O-methyl-u
  modified_base (24)..(24): 2'-O-methyl-c
  modified_base (25)..(25): 2'-O-methyl-g
  modified_base (26)..(26): benzyl-dU
ggcagguuugguauuaauuaagucgugg

SEQ ID NO: 321 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  misc_feature (17)..(18): Heg linker between nucleotides
  modified_base (18)..(18): tyrosyl-dU
  modified_base (19)..(19): benzyl-dU
  modified_base (20)..(20): 2'-O-methyl-a
  modified_base (23)..(23): 2'-O-methyl-u
  modified_base (24)..(24): 2'-O-methyl-c
  modified_base (26)..(26): benzyl-dU
ggcagguuugguauuaauuaagucgugg

SEQ ID NO: 322 - DNA, 28 bp, Artificial Sequence
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): phenethyl-dU
  modified_base (12)..(12): naphthyl-dU
  modified_base (13)..(13): 2'-O-methyl-a
  modified_base (14)..(14): benzyl-dU
  modified_base (15)..(15): benzyl-dU
  modified_base (16)..(16): 2'-O-methyl-a
  misc_feature (17)..(18): Heg linker between nucleotides
  modified_base (18)..(18): tyrosyl-dU
  modified_base (19)..(19): benzyl-dU
  modified_base (20)..(20): 2'-O-methyl-a
  modified_base (23)..(23): 2'-O-methyl-u
  modified_base (24)..(24): 2'-O-methyl-c
  modified_base (26)..(26): benzyl-dU
ggcagguuugguauuaauuaagucgugg

SEQ ID NO: 323 - DNA, 31 bp, Artificial Sequence; identical to SEQ ID NO: 104
  Description of Artificial Sequence: Synthetic oligonucleotide
  Description of Combined DNA/RNA Molecule: Synthetic oligonucleotide
  modified_base (1)..(1): 2'-O-methyl-g
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (24)..(24): 2'-O-methyl-a
  modified_base (27)..(27): 2'-O-methyl-u
  misc_feature (27)..(28): C3 linker between nucleotides
  modified_base (29)..(29): benzyl-dU

SEQ ID NO: 324 - DNA, 31 bp, Artificial Sequence; identical to SEQ ID NO: 104
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (24)..(24): 2'-O-methyl-a
  modified_base (27)..(27): 2'-O-methyl-u
  misc_feature (27)..(28): C3 linker between nucleotides
  modified_base (28)..(28): 2'-O-methyl-g
  modified_base (29)..(29): benzyl-dU

SEQ ID NO: 325 - DNA, 31 bp, Artificial Sequence; identical to SEQ ID NO: 104
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (24)..(24): 2'-O-methyl-a
  modified_base (27)..(27): 2'-O-methyl-u
  misc_feature (27)..(28): C3 linker between nucleotides
  modified_base (29)..(29): benzyl-dU

SEQ ID NO: 326 - DNA, 31 bp, Artificial Sequence; identical to SEQ ID NO: 104
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (18)..(18): 2'-O-methyl-c
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (24)..(24): 2'-O-methyl-a
  modified_base (27)..(27): 2'-O-methyl-u
  misc_feature (27)..(28): C3 linker between nucleotides
  modified_base (29)..(29): benzyl-dU

SEQ ID NO: 327 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (10)..(10): 2'-O-methyl-g
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): 2'-O-methyl-u
  modified_base (24)..(24): 2'-O-methyl-a
  modified_base (27)..(27): benzyl-dU
  modified_base (28)..(28): 2'-O-methyl-c
  modified_base (30)..(30): benzyl-dU

SEQ ID NO: 328 - DNA, 31 bp, Artificial Sequence; identical to SEQ ID NO: 104
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): tyrosyl-dU
  modified_base (16)..(16): 2'-O-methyl-a
  modified_base (17)..(17): 2'-O-methyl-a
  modified_base (19)..(19): 2'-O-methyl-a
  modified_base (20)..(20): 2'-O-methyl-c
  modified_base (22)..(22): tyrosyl-dU
  modified_base (23)..(23): benzyl-dU
  modified_base (24)..(24): 2'-O-methyl-a
  modified_base (25)..(25): 2'-fluoro-a
  modified_base (26)..(26): 2'-O-methyl-g
  modified_base (27)..(27): 2'-O-methyl-u
  misc_feature (27)..(28): C3 linker between nucleotides
  modified_base (29)..(29): tyrosyl-dU
  modified_base (31)..(31): 2'-O-methyl-g

SEQ ID NO: 329 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-benzyl-dU
  modified_base (10)..(10): 2'-O-methyl-g
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): 2'-O-methyl-benzyl-dU
  modified_base (24)..(24): 2'-O-methyl-a
  modified_base (27)..(27): benzyl-dU
  modified_base (28)..(28): 2'-O-methyl-c
  modified_base (30)..(30): benzyl-dU

SEQ ID NO: 330 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): 2'-O-methyl-u
  modified_base (21)..(21): benzyl-dU
  modified_base (22)..(22): 2'-O-methyl-a
  modified_base (23)..(23): 2'-fluoro-a
  modified_base (24)..(24): 2'-O-methyl-g
  modified_base (25)..(25): 2'-O-methyl-u
  modified_base (26)..(26): 2'-O-methyl-c
  modified_base (28)..(28): benzyl-dU
  modified_base (30)..(30): 2'-O-methyl-g

SEQ ID NO: 331 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): 2'-O-methyl-u
  modified_base (21)..(21): 2'-O-methyl-u
  modified_base (22)..(22): 2'-O-methyl-a
  modified_base (23)..(23): 2'-fluoro-a
  modified_base (24)..(24): 2'-O-methyl-g
  modified_base (25)..(25): 2'-O-methyl-u
  modified_base (26)..(26): 2'-O-methyl-c
  modified_base (28)..(28): benzyl-dU
  modified_base (30)..(30): 2'-O-methyl-g

SEQ ID NO: 332 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): 2'-O-methyl-u
  modified_base (21)..(21): benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (28)..(28): benzyl-dU
  modified_base (30)..(30): 2'-O-methyl-g

SEQ ID NO: 333 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): 2'-O-methyl-u
  modified_base (21)..(21): 2'-O-methyl-u
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (28)..(28): benzyl-dU
  modified_base (30)..(30): 2'-O-methyl-g

SEQ ID NO: 334 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): 2'-O-methyl-u
  modified_base (8)..(8): benzyl-dU
  modified_base (9)..(9): 2'-O-methyl-benzyl-dU
  modified_base (12)..(12): naphthyl-dU
  modified_base (14)..(14): benzyl-dU
  modified_base (15)..(15): 2'-O-methyl-benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): 2'-O-methyl-benzyl-dU
  modified_base (21)..(21): 2'-O-methyl-benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (28)..(28): benzyl-dU
  modified_base (30)..(30): 2'-O-methyl-g

SEQ ID NO: 335 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): 2'-O-methyl-benzyl-dU
  modified_base (8)..(8): benzyl-dU
  modified_base (9)..(9): 2'-O-methyl-benzyl-dU
  modified_base (12)..(12): 2'-O-methyl-u
  modified_base (14)..(14): benzyl-dU
  modified_base (15)..(15): 2'-O-methyl-benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): 2'-O-methyl-benzyl-dU
  modified_base (21)..(21): 2'-O-methyl-benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (28)..(28): benzyl-dU
  modified_base (30)..(30): 2'-O-methyl-g

SEQ ID NO: 336 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): 2'-O-methyl-benzyl-dU
  modified_base (8)..(8): benzyl-dU
  modified_base (9)..(9): 2'-O-methyl-benzyl-dU
  modified_base (12)..(12): naphthyl-dU
  modified_base (14)..(14): benzyl-dU
  modified_base (15)..(15): 2'-O-methyl-u
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): 2'-O-methyl-benzyl-dU
  modified_base (21)..(21): 2'-O-methyl-benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (28)..(28): benzyl-dU
  modified_base (30)..(30): 2'-O-methyl-g

SEQ ID NO: 337 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): 2'-O-methyl-benzyl-dU
  modified_base (8)..(8): benzyl-dU
  modified_base (9)..(9): 2'-O-methyl-benzyl-dU
  modified_base (12)..(12): naphthyl-dU
  modified_base (14)..(14): benzyl-dU
  modified_base (15)..(15): 2'-O-methyl-benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): 2'-O-methyl-benzyl-dU
  modified_base (21)..(21): 2'-O-methyl-u
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (28)..(28): benzyl-dU
  modified_base (30)..(30): 2'-O-methyl-g

SEQ ID NO: 338 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): 2'-O-methyl-u
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): benzyl-dU
  modified_base (21)..(21): benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (28)..(28): benzyl-dU
  modified_base (30)..(30): 2'-O-methyl-g

SEQ ID NO: 339 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): 2'-O-methyl-u
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): benzyl-dU
  modified_base (21)..(21): benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (28)..(28): benzyl-dU
  modified_base (30)..(30): 2'-O-methyl-g

SEQ ID NO: 340 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): 2'-O-methyl-u
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): benzyl-dU
  modified_base (21)..(21): benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (28)..(28): benzyl-dU
  modified_base (30)..(30): 2'-O-methyl-g

SEQ ID NO: 341 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): 2'-O-methyl-u
  modified_base (21)..(21): benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (28)..(28): benzyl-dU
  modified_base (30)..(30): 2'-O-methyl-g

SEQ ID NO: 342 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): benzyl-dU
  modified_base (21)..(21): 2'-O-methyl-u
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (28)..(28): benzyl-dU
  modified_base (30)..(30): 2'-O-methyl-g

SEQ ID NO: 343 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): 3-benzofuranylethyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): benzyl-dU
  modified_base (21)..(21): benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): benzyl-dU
  modified_base (26)..(26): 2'-O-methyl-c
  modified_base (28)..(28): benzyl-dU
  modified_base (30)..(30): 2'-O-methyl-g

SEQ ID NO: 344 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): 3-benzofuranylethyl-dU
  modified_base (8)..(8): benzyl-dU
  modified_base (9)..(9): phenethyl-dU
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): benzyl-dU
  modified_base (21)..(21): benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): benzyl-dU
  modified_base (26)..(26): 2'-O-methyl-c
  modified_base (28)..(28): isobutyl-dU
  modified_base (30)..(30): 2'-O-methyl-g

SEQ ID NO: 345 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): 3-benzofuranylethyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): benzyl-dU
  modified_base (21)..(21): benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): benzyl-dU
  modified_base (26)..(26): 2'-O-methyl-c
  modified_base (28)..(28): benzyl-dU
  modified_base (30)..(30): 2'-O-methyl-g

SEQ ID NO: 346 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): methylenedioxybenzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): benzyl-dU
  modified_base (21)..(21): benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): benzyl-dU
  modified_base (26)..(26): 2'-O-methyl-c
  modified_base (28)..(28): benzyl-dU
  modified_base (30)..(30): 2'-O-methyl-g

SEQ ID NO: 347 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): benzyl-dU
  modified_base (21)..(21): benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): benzyl-dU
  modified_base (26)..(26): 2'-O-methyl-c
  modified_base (28)..(28): isobutyl-dU
  modified_base (30)..(30): 2'-O-methyl-g

SEQ ID NO: 348 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): 3-benzofuranylethyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): benzyl-dU
  modified_base (21)..(21): benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): benzyl-dU
  modified_base (26)..(26): 2'-O-methyl-c
  modified_base (28)..(28): isobutyl-dU
  modified_base (30)..(30): 2'-O-methyl-g

SEQ ID NO: 349 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): methylenedioxybenzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): benzyl-dU
  modified_base (21)..(21): benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): benzyl-dU
  modified_base (26)..(26): 2'-O-methyl-c
  modified_base (28)..(28): isobutyl-dU
  modified_base (30)..(30): 2'-O-methyl-g

SEQ ID NO: 350 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): methylenedioxybenzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): 2'-O-methyl-benzyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): 2'-O-methyl-benzyl-dU
  modified_base (21)..(21): 2'-O-methyl-benzyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (27)..(27): phosphorothioate-(deoxyribose)-g
  modified_base (28)..(28): phosphorothioate-(deoxyribose)-benzyl-dU
  modified_base (29)..(29): phosphorothioate-(deoxyribose)-g
  modified_base (30)..(30): 2'-O-methyl-g

SEQ ID NO: 351 - DNA, 32 bp, Artificial Sequence; identical to SEQ ID NO: 22
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): benzyl-dU
  modified_base (8)..(8): benzyl-dU
  modified_base (9)..(9): 2'-O-methyl-u
  modified_base (12)..(12): naphthyl-dU
  modified_base (14)..(14): phosphorothioate-(deoxyribose)-benzyl-dU
  modified_base (15)..(15): 2'-O-methyl-benzyl-dU
  modified_base (16)..(16): 2'-O-methyl-a
  modified_base (19)..(19): 2'-O-methyl-a
  modified_base (20)..(20): 2'-O-methyl-c
  modified_base (22)..(22): benzyl-dU
  modified_base (23)..(23): benzyl-dU
  modified_base (24)..(24): 2'-O-methyl-a
  modified_base (27)..(27): benzyl-dU
  modified_base (28)..(28): 2'-O-methyl-c
  modified_base (30)..(30): phosphorothioate-(deoxyribose)-benzyl-dU
  modified_base (32)..(32): 2'-O-methyl-g

SEQ ID NO: 352 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): methylenedioxybenzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): morpholinoethyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): morpholinoethyl-dU
  modified_base (21)..(21): morpholinoethyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (28)..(28): morpholinoethyl-dU
  modified_base (30)..(30): 2'-O-methyl-g

SEQ ID NO: 353 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): methylenedioxybenzyl-dU
  modified_base (8)..(8): benzyl-dU
  modified_base (9)..(9): 2'-O-methyl-u
  modified_base (12)..(12): naphthyl-dU
  modified_base (14)..(14): benzyl-dU
  modified_base (15)..(15): morpholinoethyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): morpholinoethyl-dU
  modified_base (21)..(21): morpholinoethyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (28)..(28): morpholinoethyl-dU
  modified_base (30)..(30): 2'-O-methyl-g

SEQ ID NO: 354 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (6)..(6): 2'-O-methyl-g
  modified_base (7)..(7): methylenedioxybenzyl-dU
  modified_base (8)..(8): benzyl-dU
  modified_base (9)..(9): morpholinoethyl-dU
  modified_base (12)..(12): naphthyl-dU
  modified_base (14)..(14): benzyl-dU
  modified_base (15)..(15): morpholinoethyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): morpholinoethyl-dU
  modified_base (21)..(21): morpholinoethyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (28)..(28): morpholinoethyl-dU
  modified_base (30)..(30): 2'-O-methyl-g

SEQ ID NO: 355 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): methylenedioxybenzyl-dU
  modified_base (8)..(8): benzyl-dU
  modified_base (9)..(9): morpholinoethyl-dU
  modified_base (12)..(12): naphthyl-dU
  modified_base (14)..(14): benzyl-dU
  modified_base (15)..(15): morpholinoethyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): morpholinoethyl-dU
  modified_base (21)..(21): morpholinoethyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (28)..(28): morpholinoethyl-dU
  modified_base (30)..(30): 2'-O-methyl-g

SEQ ID NO: 356 - DNA, 30 bp, Artificial Sequence; identical to SEQ ID NO: 107
  Description of Artificial Sequence: Synthetic oligonucleotide
  Description of Combined DNA/RNA Molecule: Synthetic oligonucleotide
  modified_base (3)..(3): 2'-O-methyl-c
  modified_base (4)..(4): 2'-O-methyl-a
  modified_base (6)..(6): 2'-O-methyl-g
  modified_base (7)..(7): 2'-O-methyl-methylenedioxybenzyl-dU
  modified_base (8)..(8): phosphorothioate-(deoxyribose)-benzyl-dU
  modified_base (9)..(9): 2'-O-methyl-morpholinoethyl-dU
  modified_base (12)..(12): phosphorothioate-(deoxyribose)-naphthyl-dU
  modified_base (13)..(13): phosphorothioate-(deoxyribose)-a
  modified_base (14)..(14): phosphorothioate-(deoxyribose)-benzyl-dU
  modified_base (15)..(15): 2'-O-methyl-morpholinoethyl-dU
  modified_base (16)..(16): 2'-O-methyl-a
  modified_base (17)..(17): 2'-O-methyl-a
  modified_base (18)..(18): 2'-O-methyl-c
  misc_feature (18)..(19): Heg linker between nucleotides
  modified_base (19)..(19): 2'-O-methyl-g
  modified_base (20)..(20): 2'-O-methyl-morpholinoethyl-dU
  modified_base (21)..(21): 2'-O-methyl-morpholinoethyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-u
  modified_base (26)..(26): 2'-O-methyl-c
  modified_base (27)..(27): phosphorothioate-(deoxyribose)-g
  modified_base (28)..(28): phosphorothioate-(deoxyribose)-morpholinoethyl-dU
  modified_base (29)..(29): phosphorothioate-(deoxyribose)-g
  modified_base (30)..(30): 2'-O-methyl-g

SEQ ID NO: 357-399 - skipped (43 entries)

SEQ ID NO: 400 - DNA, 27 bp, Artificial Sequence
  Description of Artificial Sequence: Synthetic oligonucleotide
  Description of Combined DNA/RNA Molecule: Synthetic oligonucleotide
  5'-C3 linker
  modified_base (4)..(4): naphthyl-dU
  modified_base (5)..(5): naphthyl-dU
  modified_base (7)..(7): naphthyl-dU
  modified_base (9)..(9): naphthyl-dU
  misc_feature (12)..(13): C3 linker between nucleotides-C3 linker between nucleotides
  modified_base (14)..(14): naphthyl-dU
  modified_base (18)..(18): naphthyl-dU
  modified_base (26)..(26): naphthyl-dU
ggguuauguagcgugcguaaggcggug

SEQ ID NO: 401 - DNA, 26 bp, Artificial Sequence
  Description of Artificial Sequence: Synthetic oligonucleotide
  Description of Combined DNA/RNA Molecule: Synthetic oligonucleotide
  5'-C3 linker
  modified_base (4)..(4): naphthyl-dU
  modified_base (5)..(5): naphthyl-dU
  modified_base (7)..(7): naphthyl-dU
  modified_base (9)..(9): naphthyl-dU
  misc_feature (12)..(13): C3 linker between nucleotides-C3 linker between nucleotides
  modified_base (14)..(14): naphthyl-dU
  modified_base (18)..(18): naphthyl-dU
  modified_base (26)..(26): naphthyl-dU
ggguuauguagcgugcguaaggcggu

SEQ ID NO: 402 - DNA, 27 bp, Artificial Sequence
  Description of Artificial Sequence: Synthetic oligonucleotide
  Description of Combined DNA/RNA Molecule: Synthetic oligonucleotide
  5'-C3 linker
  modified_base (1)..(1): 2'-O-methyl-g
  modified_base (2)..(2): 2'-O-methyl-g
  modified_base (3)..(3): 2'-O-methyl-g
  modified_base (4)..(4): naphthyl-dU
  modified_base (5)..(5): naphthyl-dU
  modified_base (6)..(6): 2'-O-methyl-a
  modified_base (7)..(7): naphthyl-dU
  modified_base (8)..(8): 2'-O-methyl-g
  modified_base (9)..(9): naphthyl-dU
  modified_base (10)..(10): 2'-O-methyl-a
  modified_base (11)..(11): 2'-O-methyl-g
  modified_base (12)..(12): 2'-O-methyl-c
  misc_feature (12)..(13): C3 linker between nucleotides-C3 linker between nucleotides
  modified_base (13)..(13): 2'-O-methyl-g
  modified_base (14)..(14): naphthyl-dU
  modified_base (15)..(15): 2'-O-methyl-g
  modified_base (16)..(16): 2'-O-methyl-c
  modified_base (17)..(17): 2'-O-methyl-g
  modified_base (18)..(18): naphthyl-dU
  modified_base (19)..(19): 2'-O-methyl-a
  modified_base (20)..(20): 2'-O-methyl-a
  modified_base (21)..(21): 2'-O-methyl-g
  modified_base (22)..(22): 2'-O-methyl-g
  modified_base (23)..(23): 2'-O-methyl-c
  modified_base (24)..(24): 2'-O-methyl-g
  modified_base (25)..(25): 2'-O-methyl-g
  modified_base (26)..(26): naphthyl-dU
  modified_base (27)..(27): 2'-O-methyl-g
ggguuauguagcgugcguaaggcggug

SEQ ID NO: 403 - DNA, 26 bp, Artificial Sequence
  Description of Artificial Sequence: Synthetic oligonucleotide
  Description of Combined DNA/RNA Molecule: Synthetic oligonucleotide
  5'-C3 linker
  modified_base (4)..(4): naphthyl-dU
  modified_base (5)..(5): naphthyl-dU
  modified_base (7)..(7): naphthyl-dU
  modified_base (9)..(9): naphthyl-dU
  modified_base (10)..(10): 2'-fluoro-a
  modified_base (11)..(11): 2'-fluoro-g
  modified_base (12)..(12): 2'-fluoro-c
  misc_feature (12)..(13): C3 linker between nucleotides-C3 linker between nucleotides
  modified_base (13)..(13): 2'-fluoro-g
  modified_base (14)..(14): naphthyl-dU
  modified_base (18)..(18): naphthyl-dU
  modified_base (26)..(26): naphthyl-dU
ggguuauguagcgugcguaaggcggu

SEQ ID NO: 404 - DNA, 26 bp, Artificial Sequence
  Description of Artificial Sequence: Synthetic oligonucleotide
  Description of Combined DNA/RNA Molecule: Synthetic oligonucleotide
  5'-C3 linker
  modified_base (2)..(2): 2'-O-methyl-g
  modified_base (4)..(4): naphthyl-dU
  modified_base (5)..(5): naphthyl-dU
  modified_base (7)..(7): naphthyl-dU
  modified_base (9)..(9): naphthyl-dU
  misc_feature (12)..(13): C3 linker between nucleotides-C3 linker between nucleotides
  modified_base (14)..(14): naphthyl-dU
  modified_base (15)..(15): 2'-O-methyl-g
  modified_base (18)..(18): naphthyl-dU
  modified_base (26)..(26): naphthyl-dU
ggguuauguagcgugcguaaggcggu

SEQ ID NO: 405 - DNA, 26 bp, Artificial Sequence
  Description of Artificial Sequence: Synthetic oligonucleotide
  Description of Combined DNA/RNA Molecule: Synthetic oligonucleotide
  5'-C3 linker
  modified_base (2)..(2): 2'-O-methyl-g
  modified_base (4)..(4): naphthyl-dU
  modified_base (5)..(5): naphthyl-dU
  modified_base (7)..(7): naphthyl-dU
  modified_base (9)..(9): naphthyl-dU
  misc_feature (12)..(13): C3 linker between nucleotides-C3 linker between nucleotides
  modified_base (14)..(14): naphthyl-dU
  modified_base (15)..(15): 2'-O-methyl-g
  modified_base (18)..(18): naphthyl-dU
  modified_base (24)..(24): 2'-O-methyl-g
  modified_base (25)..(25): 2'-O-methyl-g
  modified_base (26)..(26): naphthyl-dU
ggguuauguagcgugcguaaggcggu

SEQ ID NO: 406 - DNA, 26 bp, Artificial Sequence
  Description of Artificial Sequence: Synthetic oligonucleotide
  Description of Combined DNA/RNA Molecule: Synthetic oligonucleotide
  5'-C3 linker
  modified_base (2)..(2): 2'-O-methyl-g
  modified_base (4)..(4): 2'-O-methyl-naphthyl-dU
  modified_base (5)..(5): naphthyl-dU
  modified_base (7)..(7): naphthyl-dU
  modified_base (9)..(9): naphthyl-dU
  misc_feature (12)..(13): C3 linker between nucleotides-C3 linker between nucleotides
  modified_base (14)..(14): naphthyl-dU
  modified_base (15)..(15): 2'-O-methyl-g
  modified_base (18)..(18): naphthyl-dU
  modified_base (24)..(24): 2'-O-methyl-g
  modified_base (25)..(25): 2'-O-methyl-g
  modified_base (26)..(26): naphthyl-dU
ggguuauguagcgugcguaaggcggu

SEQ ID NO: 407 - DNA, 26 bp, Artificial Sequence
  Description of Artificial Sequence: Synthetic oligonucleotide
  Description of Combined DNA/RNA Molecule: Synthetic oligonucleotide
  5'-C3 linker
  modified_base (2)..(2): 2'-O-methyl-g
  modified_base (4)..(4): naphthyl-dU
  modified_base (5)..(5): naphthyl-dU
  modified_base (7)..(7): naphthyl-dU
  modified_base (9)..(9): 2'-O-methyl-naphthyl-dU
  misc_feature (12)..(13): C3 linker between nucleotides-C3 linker between nucleotides
  modified_base (14)..(14): naphthyl-dU
  modified_base (15)..(15): 2'-O-methyl-g
  modified_base (18)..(18): naphthyl-dU
  modified_base (24)..(24): 2'-O-methyl-g
  modified_base (25)..(25): 2'-O-methyl-g
  modified_base (26)..(26): naphthyl-dU
ggguuauguagcgugcguaaggcggu

SEQ ID NO: 408 - DNA, 26 bp, Artificial Sequence
  Description of Artificial Sequence: Synthetic oligonucleotide
  Description of Combined DNA/RNA Molecule: Synthetic oligonucleotide
  5'-C3 linker
  modified_base (2)..(2): 2'-O-methyl-g
  modified_base (4)..(4): naphthyl-dU
  modified_base (5)..(5): naphthyl-dU
  modified_base (7)..(7): naphthyl-dU
  modified_base (9)..(9): naphthyl-dU
  misc_feature (12)..(13): C3 linker between nucleotides-C3 linker between nucleotides
  modified_base (14)..(14): 2'-O-methyl-naphthyl-dU
  modified_base (15)..(15): 2'-O-methyl-g
  modified_base (18)..(18): naphthyl-dU
  modified_base (24)..(24): 2'-O-methyl-g
  modified_base (25)..(25): 2'-O-methyl-g
  modified_base (26)..(26): naphthyl-dU
ggguuauguagcgugcguaaggcggu

SEQ ID NO: 409 - DNA, 26 bp, Artificial Sequence
  Description of Artificial Sequence: Synthetic oligonucleotide
  Description of Combined DNA/RNA Molecule: Synthetic oligonucleotide
  5'-C3 linker
  modified_base (2)..(2): 2'-O-methyl-g
  modified_base (4)..(4): naphthyl-dU
  modified_base (5)..(5): naphthyl-dU
  modified_base (7)..(7): naphthyl-dU
  modified_base (9)..(9): naphthyl-dU
  misc_feature (12)..(13): C3 linker between nucleotides-C3 linker between nucleotides
  modified_base (14)..(14): naphthyl-dU
  modified_base (15)..(15): 2'-O-methyl-g
  modified_base (18)..(18): 2'-O-methyl-naphthyl-dU
  modified_base (24)..(24): 2'-O-methyl-g
  modified_base (25)..(25): 2'-O-methyl-g
  modified_base (26)..(26): naphthyl-dU
ggguuauguagcgugcguaaggcggu

SEQ ID NO: 410 - DNA, 26 bp, Artificial Sequence
  Description of Artificial Sequence: Synthetic oligonucleotide
  Description of Combined DNA/RNA Molecule: Synthetic oligonucleotide
  5'-C3 linker
  modified_base (2)..(2): 2'-O-methyl-g
  modified_base (4)..(4): naphthyl-dU
  modified_base (5)..(5): naphthyl-dU
  modified_base (7)..(7): naphthyl-dU
  modified_base (9)..(9): naphthyl-dU
  misc_feature (12)..(13): C3 linker between nucleotides-C3 linker between nucleotides
  modified_base (14)..(14): naphthyl-dU
  modified_base (15)..(15): 2'-O-methyl-g
  modified_base (18)..(18): naphthyl-dU
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 411 - DNA, 26 bp, Artificial Sequence
  Description of Artificial Sequence: Synthetic oligonucleotide
  Description of Combined DNA/RNA Molecule: Synthetic oligonucleotide
  5'-C3 linker
  modified_base (2)..(2): 2'-O-methyl-g
  modified_base (4)..(4): 2'-O-methyl-naphthyl-dU
  modified_base (5)..(5): 2'-O-methyl-naphthyl-dU
  modified_base (7)..(7): naphthyl-dU
  modified_base (9)..(9): naphthyl-dU
  misc_feature (12)..(13): C3 linker between nucleotides-C3 linker between nucleotides
  modified_base (14)..(14): naphthyl-dU
  modified_base (15)..(15): 2'-O-methyl-g
  modified_base (18)..(18): naphthyl-dU
  modified_base (24)..(24): 2'-O-methyl-g
  modified_base (25)..(25): 2'-O-methyl-g
  modified_base (26)..(26): naphthyl-dU
ggguuauguagcgugcguaaggcggu

SEQ ID NO: 412 - DNA, 26 bp, Artificial Sequence
  Description of Artificial Sequence: Synthetic oligonucleotide
  Description of Combined DNA/RNA Molecule: Synthetic oligonucleotide
  5'-C3 linker
  modified_base (2)..(2): 2'-O-methyl-g
  modified_base (4)..(4): naphthyl-dU
  modified_base (5)..(5): naphthyl-dU
  modified_base (7)..(7): naphthyl-dU
  modified_base (9)..(9): naphthyl-dU
  misc_feature (12)..(13): C3 linker between nucleotides-C3 linker between nucleotides
  modified_base (14)..(14): 2'-O-methyl-naphthyl-dU
  modified_base (15)..(15): 2'-O-methyl-g
  modified_base (18)..(18): 2'-O-methyl-naphthyl-dU
  modified_base (24)..(24): 2'-O-methyl-g
  modified_base (25)..(25): 2'-O-methyl-g
  modified_base (26)..(26): naphthyl-dU
ggguuauguagcgugcguaaggcggu

SEQ ID NO: 413 - DNA, 26 bp, Artificial Sequence
  Description of Artificial Sequence: Synthetic oligonucleotide
  Description of Combined DNA/RNA Molecule: Synthetic oligonucleotide
  5'-C3 linker
  modified_base (2)..(2): 2'-O-methyl-g
  modified_base (4)..(4): naphthyl-dU
  modified_base (5)..(5): naphthyl-dU
  modified_base (7)..(7): naphthyl-dU
  modified_base (9)..(9): 2'-O-methyl-naphthyl-dU
  misc_feature (12)..(13): C3 linker between nucleotides-C3 linker between nucleotides
  modified_base (14)..(14): 2'-O-methyl-naphthyl-dU
  modified_base (15)..(15): 2'-O-methyl-g
  modified_base (18)..(18): 2'-O-methyl-naphthyl-dU
  modified_base (24)..(24): 2'-O-methyl-g
  modified_base (25)..(25): 2'-O-methyl-g
  modified_base (26)..(26): naphthyl-dU
ggguuauguagcgugcguaaggcggu

SEQ ID NO: 414 - DNA, 26 bp, Artificial Sequence
  Description of Artificial Sequence: Synthetic oligonucleotide
  Description of Combined DNA/RNA Molecule: Synthetic oligonucleotide
  5'-C3 linker
  modified_base (2)..(2): 2'-O-methyl-g
  modified_base (4)..(4): 2'-O-methyl-naphthyl-dU
  modified_base (5)..(5): naphthyl-dU
  modified_base (7)..(7): naphthyl-dU
  modified_base (9)..(9): naphthyl-dU
  misc_feature (12)..(13): C3 linker between nucleotides-C3 linker between nucleotides
  modified_base (14)..(14): naphthyl-dU
  modified_base (15)..(15): 2'-O-methyl-g
  modified_base (18)..(18): naphthyl-dU
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 415 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): naphthyl-dU
  modified_base (5)..(5): naphthyl-dU
  modified_base (7)..(7): naphthyl-dU
  modified_base (9)..(9): naphthyl-dU
  misc_feature (12)..(13): C3 linker between nucleotides-C3 linker between nucleotides
  modified_base (14)..(14): naphthyl-dU
  modified_base (15)..(15): 2'-O-methyl-g
  modified_base (18)..(18): naphthyl-dU
  modified_base (24)..(24): 2'-O-methyl-g
  modified_base (25)..(25): 2'-O-methyl-g
  modified_base (26)..(26): naphthyl-dU
ggguuauguagcgugcguaaggcggu

SEQ ID NO: 416 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): naphthyl-dU
  modified_base (5)..(5): naphthyl-dU
  modified_base (7)..(7): naphthyl-dU
  modified_base (9)..(9): naphthyl-dU
  misc_feature (12)..(13): C3 linker between nucleotides-C3 linker between nucleotides
  modified_base (14)..(14): 2'-O-methyl-u
  modified_base (15)..(15): 2'-O-methyl-g
  modified_base (18)..(18): naphthyl-dU
  modified_base (24)..(24): 2'-O-methyl-g
  modified_base (25)..(25): 2'-O-methyl-g
  modified_base (26)..(26): naphthyl-dU
ggguuauguagcgugcguaaggcggu

SEQ ID NO: 417 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): naphthyl-dU
  modified_base (7)..(7): naphthyl-dU
  modified_base (9)..(9): 2'-O-methyl-naphthyl-dU
  misc_feature (12)..(13): C3 linker between nucleotides-C3 linker between nucleotides
  modified_base (14)..(14): 2'-O-methyl-naphthyl-dU
  modified_base (15)..(15): 2'-O-methyl-g
  modified_base (18)..(18): 2'-O-methyl-naphthyl-dU
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 418 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): naphthyl-dU
  modified_base (5)..(5): naphthyl-dU
  modified_base (7)..(7): naphthyl-dU
  modified_base (9)..(9): 2'-O-methyl-naphthyl-dU
  misc_feature (12)..(13): C3 linker between nucleotides-C3 linker between nucleotides
  modified_base (14)..(14): 2'-O-methyl-naphthyl-dU
  modified_base (15)..(15): 2'-O-methyl-g
  modified_base (18)..(18): 2'-O-methyl-naphthyl-dU
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 419 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): naphthyl-dU
  modified_base (7)..(7): naphthyl-dU
  modified_base (9)..(9): 2'-O-methyl-naphthyl-dU
  misc_feature (12)..(13): C3 linker between nucleotides-C3 linker between nucleotides
  modified_base (14)..(14): 2'-O-methyl-naphthyl-dU
  modified_base (15)..(15): 2'-O-methyl-g
  modified_base (18)..(18): 2'-O-methyl-naphthyl-dU
  modified_base (24)..(24): 2'-O-methyl-g
  modified_base (25)..(25): 2'-O-methyl-g
  modified_base (26)..(26): naphthyl-dU
ggguuauguagcgugcguaaggcggu

SEQ ID NO: 420 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): naphthyl-dU
  modified_base (7)..(7): naphthyl-dU
  modified_base (9)..(9): 2'-O-methyl-naphthyl-dU
  misc_feature (12)..(13): C3 linker between nucleotides-C3 linker between nucleotides
  modified_base (14)..(14): 2'-O-methyl-u
  modified_base (15)..(15): 2'-O-methyl-g
  modified_base (18)..(18): 2'-O-methyl-naphthyl-dU
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 421 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (7)..(7): naphthyl-dU
  modified_base (9)..(9): 2'-O-methyl-naphthyl-dU
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-naphthyl-dU
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 422 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (7)..(7): naphthyl-dU
  modified_base (9)..(9): 2'-O-methyl-naphthyl-dU
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-naphthyl-dU
  modified_base (22)..(22): phosphorothioate-(deoxyribose)-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 423 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (7)..(7): phosphorothioate-(deoxyribose)-naphthyl-dU
  modified_base (9)..(9): 2'-O-methyl-naphthyl-dU
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-naphthyl-dU
  modified_base (22)..(22): phosphorothioate-(deoxyribose)-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 424 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (7)..(7): phosphorothioate-(deoxyribose)-naphthyl-dU
  modified_base (9)..(9): 2'-O-methyl-morpholinoethyl-dU
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-naphthyl-dU
  modified_base (22)..(22): phosphorothioate-(deoxyribose)-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 425 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (7)..(7): phosphorothioate-(deoxyribose)-naphthyl-dU
  modified_base (9)..(9): 2'-O-methyl-naphthyl-dU
  misc_feature (12)..(13): C3 linker between nucleotides-C3 linker between nucleotides
  modified_base (13)..(13): 2'-O-methyl-g
  modified_base (14)..(14): 2'-O-methyl-morpholinoethyl-dU
  modified_base (15)..(15): 2'-O-methyl-g
  modified_base (18)..(18): 2'-O-methyl-naphthyl-dU
  modified_base (22)..(22): phosphorothioate-(deoxyribose)-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 426 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (7)..(7): phosphorothioate-(deoxyribose)-naphthyl-dU
  modified_base (9)..(9): 2'-O-methyl-R-tetrahydrofuranyl-dU
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-naphthyl-dU
  modified_base (22)..(22): phosphorothioate-(deoxyribose)-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 427 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (7)..(7): phosphorothioate-(deoxyribose)-naphthyl-dU
  modified_base (9)..(9): 2'-O-methyl-naphthyl-dU
  misc_feature (12)..(13): C3 linker between nucleotides-C3 linker between nucleotides
  modified_base (13)..(13): 2'-O-methyl-g
  modified_base (14)..(14): 2'-O-methyl-R-tetrahydrofuranyl-dU
  modified_base (15)..(15): 2'-O-methyl-g
  modified_base (18)..(18): 2'-O-methyl-naphthyl-dU
  modified_base (22)..(22): phosphorothioate-(deoxyribose)-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 428 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-pyridyl-dU
  modified_base (5)..(5): phosphorothioate-(deoxyribose)-naphthyl-dU
  modified_base (7)..(7): phosphorothioate-(deoxyribose)-naphthyl-dU
  modified_base (9)..(9): 2'-O-methyl-naphthyl-dU
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-naphthyl-dU
  modified_base (22)..(22): phosphorothioate-(deoxyribose)-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 429 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (7)..(7): phosphorothioate-(deoxyribose)-naphthyl-dU
  modified_base (9)..(9): 2'-O-methyl-naphthyl-dU
  misc_feature (12)..(13): C3 linker between nucleotides-C3 linker between nucleotides
  modified_base (13)..(13): 2'-O-methyl-g
  modified_base (14)..(14): 2'-O-methyl-pyridyl-dU
  modified_base (15)..(15): 2'-O-methyl-g
  modified_base (18)..(18): 2'-O-methyl-naphthyl-dU
  modified_base (22)..(22): phosphorothioate-(deoxyribose)-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 430 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (7)..(7): phosphorothioate-(deoxyribose)-naphthyl-dU
  modified_base (9)..(9): 2'-O-methyl-naphthyl-dU
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-pyridyl-dU
  modified_base (22)..(22): phosphorothioate-(deoxyribose)-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 431 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-methylenedioxybenzyl-dU
  modified_base (5)..(5): phosphorothioate-(deoxyribose)-naphthyl-dU
  modified_base (7)..(7): phosphorothioate-(deoxyribose)-naphthyl-dU
  modified_base (9)..(9): 2'-O-methyl-naphthyl-dU
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-naphthyl-dU
  modified_base (22)..(22): phosphorothioate-(deoxyribose)-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 432 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (7)..(7): phosphorothioate-(deoxyribose)-naphthyl-dU
  modified_base (9)..(9): 2'-O-methyl-methylenedioxybenzyl-dU
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-naphthyl-dU
  modified_base (22)..(22): phosphorothioate-(deoxyribose)-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 433 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (7)..(7): phosphorothioate-(deoxyribose)-naphthyl-dU
  modified_base (9)..(9): 2'-O-methyl-naphthyl-dU
  misc_feature (12)..(13): C3 linker between nucleotides-C3 linker between nucleotides
  modified_base (13)..(13): 2'-O-methyl-g
  modified_base (14)..(14): 2'-O-methyl-methylenedioxybenzyl-dU
  modified_base (15)..(15): 2'-O-methyl-g
  modified_base (18)..(18): 2'-O-methyl-naphthyl-dU
  modified_base (22)..(22): phosphorothioate-(deoxyribose)-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 434 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (7)..(7): phosphorothioate-(deoxyribose)-naphthyl-dU
  modified_base (9)..(9): 2'-O-methyl-naphthyl-dU
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-methylenedioxybenzyl-dU
  modified_base (22)..(22): phosphorothioate-(deoxyribose)-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 435 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (7)..(7): phosphorothioate-(deoxyribose)-naphthyl-dU
  modified_base (9)..(9): 2'-O-methyl-naphthyl-dU
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-naphthyl-dU
  modified_base (22)..(22): phosphorothioate-(deoxyribose)-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-methylenedioxybenzyl-dU
ggguuauguagcgugcguaaggcggu

SEQ ID NO: 436 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (7)..(7): phosphorothioate-(deoxyribose)-naphthyl-dU
  modified_base (9)..(9): 2'-O-methyl-naphthyl-dU
  modified_base (11)..(11): 2'-O-methyl-g
  modified_base (12)..(12): 2'-O-methyl-c
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-naphthyl-dU
  modified_base (22)..(22): phosphorothioate-(deoxyribose)-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 437 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (7)..(7): phosphorothioate-(deoxyribose)-naphthyl-dU
  modified_base (8)..(8): 2'-O-methyl-g
  modified_base (9)..(9): 2'-O-methyl-naphthyl-dU
  modified_base (11)..(11): 2'-O-methyl-g
  modified_base (12)..(12): 2'-O-methyl-c
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-naphthyl-dU
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 438 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (7)..(7): phosphorothioate-(deoxyribose)-naphthyl-dU
  modified_base (9)..(9): 2'-O-methyl-naphthyl-dU
  modified_base (11)..(11): 2'-O-methyl-g
  modified_base (12)..(12): 2'-O-methyl-c
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-naphthyl-dU
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 439 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (7)..(7): phosphorothioate-(deoxyribose)-naphthyl-dU
  modified_base (9)..(9): 2'-O-methyl-naphthyl-dU
  modified_base (11)..(11): 2'-O-methyl-g
  modified_base (12)..(12): 2'-O-methyl-c
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (16)..(16): phosphorothioate-(deoxyribose)-c
  modified_base (17)..(17): phosphorothioate-(deoxyribose)-g
  modified_base (18)..(18): 2'-O-methyl-naphthyl-dU
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 440 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (7)..(7): phosphorothioate-(deoxyribose)-naphthyl-dU
  modified_base (9)..(9): 2'-O-methyl-naphthyl-dU
  modified_base (11)..(11): 2'-O-methyl-g
  modified_base (12)..(12): 2'-O-methyl-c
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-naphthyl-dU
  modified_base (19)..(19): phosphorothioate-(deoxyribose)-a
  modified_base (20)..(20): phosphorothioate-(deoxyribose)-a
  modified_base (21)..(21): phosphorothioate-(deoxyribose)-g
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 441 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (7)..(7): phosphorothioate-(deoxyribose)-naphthyl-dU
  modified_base (9)..(9): 2'-O-methyl-naphthyl-dU
  modified_base (11)..(11): 2'-O-methyl-g
  modified_base (12)..(12): 2'-O-methyl-c
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (16)..(16): phosphorothioate-(deoxyribose)-c
  modified_base (17)..(17): phosphorothioate-(deoxyribose)-g
  modified_base (18)..(18): 2'-O-methyl-naphthyl-dU
  modified_base (19)..(19): phosphorothioate-(deoxyribose)-a
  modified_base (20)..(20): phosphorothioate-(deoxyribose)-a
  modified_base (21)..(21): phosphorothioate-(deoxyribose)-g
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 442 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (7)..(7): phosphorothioate-(deoxyribose)-naphthyl-dU
  modified_base (9)..(9): 2'-O-methyl-naphthyl-dU
  modified_base (10)..(10): phosphorothioate-(deoxyribose)-a
  modified_base (11)..(11): 2'-O-methyl-g
  modified_base (12)..(12): 2'-O-methyl-c
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-naphthyl-dU
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 443 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (6)..(6): phosphorothioate-(deoxyribose)-a
  modified_base (7)..(7): phosphorothioate-(deoxyribose)-naphthyl-dU
  modified_base (9)..(9): 2'-O-methyl-naphthyl-dU
  modified_base (10)..(10): phosphorothioate-(deoxyribose)-a
  modified_base (11)..(11): 2'-O-methyl-g
  modified_base (12)..(12): 2'-O-methyl-c
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (16)..(16): phosphorothioate-(deoxyribose)-c
  modified_base (17)..(17): phosphorothioate-(deoxyribose)-g
  modified_base (18)..(18): 2'-O-methyl-naphthyl-dU
  modified_base (19)..(19): phosphorothioate-(deoxyribose)-a
  modified_base (20)..(20): phosphorothioate-(deoxyribose)-a
  modified_base (21)..(21): phosphorothioate-(deoxyribose)-g
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 444 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (7)..(7): phosphorothioate-(deoxyribose)-naphthyl-dU
  modified_base (9)..(9): 2'-O-methyl-naphthyl-dU
  modified_base (11)..(11): 2'-O-methyl-g
  modified_base (12)..(12): 2'-O-methyl-c
  misc_feature (12)..(13): phosphorothioate-C3-phosphorothioate-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (16)..(16): phosphorothioate-(deoxyribose)-c
  modified_base (17)..(17): phosphorothioate-(deoxyribose)-g
  modified_base (18)..(18): 2'-O-methyl-naphthyl-dU
  modified_base (19)..(19): phosphorothioate-(deoxyribose)-a
  modified_base (20)..(20): phosphorothioate-(deoxyribose)-a
  modified_base (21)..(21): phosphorothioate-(deoxyribose)-g
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 445 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (7)..(7): phosphorothioate-(deoxyribose)-naphthyl-dU
  modified_base (9)..(9): 2'-O-methyl-naphthyl-dU
  modified_base (11)..(11): 2'-O-methyl-g
  modified_base (12)..(12): 2'-O-methyl-c
  misc_feature (12)..(13): phosphorothioate-C3-phosphorothioate-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-naphthyl-dU
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 446 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (6)..(6): phosphorothioate-(deoxyribose)-a
  modified_base (7)..(7): phosphorothioate-(deoxyribose)-naphthyl-dU
  modified_base (9)..(9): 2'-O-methyl-naphthyl-dU
  modified_base (10)..(10): phosphorothioate-(deoxyribose)-a
  modified_base (11)..(11): 2'-O-methyl-g
  modified_base (12)..(12): 2'-O-methyl-c
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-naphthyl-dU
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 447-499 - skipped (53 entries)

SEQ ID NO: 500 - DNA, 23 bp, Artificial Sequence
  Description of Artificial Sequence: Synthetic oligonucleotide
  Description of Combined DNA/RNA Molecule: Synthetic oligonucleotide
  5'-C3-C3-C3-C3 linker
  modified_base (1)..(1): naphthyl-dU
  modified_base (2)..(2): naphthyl-dU
  modified_base (4)..(4): naphthyl-dU
  modified_base (6)..(6): naphthyl-dU
  misc_feature (9)..(10): C3 linker between nucleotides-C3 linker between nucleotides
  modified_base (11)..(11): naphthyl-dU
  modified_base (15)..(15): naphthyl-dU
  modified_base (23)..(23): naphthyl-dU
uuauguagcgugcguaaggcggu

SEQ ID NO: 501 - DNA, 26 bp, Artificial Sequence
  Description of Artificial Sequence: Synthetic oligonucleotide
  Description of Combined DNA/RNA Molecule: Synthetic oligonucleotide
  5'-C3 linker
  modified_base (1)..(1): 2'-O-methyl-g
  modified_base (2)..(2): 2'-O-methyl-g
  modified_base (3)..(3): 2'-O-methyl-g
  modified_base (4)..(4): naphthyl-dU
  modified_base (5)..(5): naphthyl-dU
  modified_base (7)..(7): naphthyl-dU
  modified_base (9)..(9): naphthyl-dU
  misc_feature (12)..(13): C3 linker between nucleotides-C3 linker between nucleotides
  modified_base (14)..(14): naphthyl-dU
  modified_base (18)..(18): naphthyl-dU
  modified_base (26)..(26): naphthyl-dU
ggguuauguagcgugcguaaggcggu

SEQ ID NO: 502 - DNA, 26 bp, Artificial Sequence
  Description of Artificial Sequence: Synthetic oligonucleotide
  Description of Combined DNA/RNA Molecule: Synthetic oligonucleotide
  5'-C3 linker
  modified_base (4)..(4): naphthyl-dU
  modified_base (5)..(5): naphthyl-dU
  modified_base (7)..(7): naphthyl-dU
  modified_base (9)..(9): naphthyl-dU
  modified_base (10)..(10): 2'-O-methyl-a
  modified_base (11)..(11): 2'-O-methyl-g
  modified_base (12)..(12): 2'-O-methyl-c
  misc_feature (12)..(13): C3 linker between nucleotides-C3 linker between nucleotides
  modified_base (13)..(13): 2'-O-methyl-g
  modified_base (14)..(14): naphthyl-dU
  modified_base (18)..(18): naphthyl-dU
  modified_base (26)..(26): naphthyl-dU
ggguuauguagcgugcguaaggcggu

SEQ ID NO: 503 - DNA, 26 bp, Artificial Sequence
  Description of Artificial Sequence: Synthetic oligonucleotide
  Description of Combined DNA/RNA Molecule: Synthetic oligonucleotide
  5'-C3 linker
  modified_base (1)..(1): 2'-fluoro-g
  modified_base (2)..(2): 2'-fluoro-g
  modified_base (3)..(3): 2'-fluoro-g
  modified_base (4)..(4): naphthyl-dU
  modified_base (5)..(5): naphthyl-dU
  modified_base (7)..(7): naphthyl-dU
  modified_base (9)..(9): naphthyl-dU
  misc_feature (12)..(13): C3 linker between nucleotides-C3 linker between nucleotides
  modified_base (14)..(14): naphthyl-dU
  modified_base (18)..(18): naphthyl-dU
  modified_base (26)..(26): naphthyl-dU
ggguuauguagcgugcguaaggcggu

SEQ ID NO: 504 - DNA, 26 bp, Artificial Sequence
  Description of Artificial Sequence: Synthetic oligonucleotide
  Description of Combined DNA/RNA Molecule: Synthetic oligonucleotide
  5'-C3 linker
  modified_base (4)..(4): naphthyl-dU
  modified_base (5)..(5): naphthyl-dU
  modified_base (7)..(7): naphthyl-dU
  modified_base (9)..(9): naphthyl-dU
  misc_feature (12)..(13): C3 linker between nucleotides-C3 linker between nucleotides
  modified_base (14)..(14): naphthyl-dU
  modified_base (15)..(15): 2'-fluoro-g
  modified_base (16)..(16): 2'-fluoro-c
  modified_base (17)..(17): 2'-fluoro-g
  modified_base (18)..(18): naphthyl-dU
  modified_base (26)..(26): naphthyl-dU
ggguuauguagcgugcguaaggcggu

SEQ ID NO: 505 - DNA, 26 bp, Artificial Sequence
  Description of Artificial Sequence: Synthetic oligonucleotide
  Description of Combined DNA/RNA Molecule: Synthetic oligonucleotide
  5'-C3 linker
  modified_base (4)..(4): naphthyl-dU
  modified_base (5)..(5): naphthyl-dU
  modified_base (7)..(7): naphthyl-dU
  modified_base (9)..(9): naphthyl-dU
  misc_feature (12)..(13): C3 linker between nucleotides-C3 linker between nucleotides
  modified_base (14)..(14): naphthyl-dU
  modified_base (18)..(18): naphthyl-dU
  modified_base (19)..(19): 2'-fluoro-a
  modified_base (20)..(20): 2'-fluoro-a
  modified_base (21)..(21): 2'-fluoro-g
  modified_base (22)..(22): 2'-fluoro-g
  modified_base (23)..(23): 2'-fluoro-c
  modified_base (24)..(24): 2'-fluoro-g
  modified_base (25)..(25): 2'-fluoro-g
  modified_base (26)..(26): naphthyl-dU
ggguuauguagcgugcguaaggcggu

SEQ ID NO: 506 - DNA, 29 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl-g
  modified_base (2)..(2): 2'-O-methyl-g
  modified_base (3)..(3): 2'-O-methyl-g
  modified_base (4)..(4): 2'-O-methyl-g
  modified_base (5)..(5): 2'-O-methyl-naphthyl-dU
  modified_base (6)..(6): 2'-O-methyl-naphthyl-dU
  modified_base (7)..(7): 2'-O-methyl-a
  modified_base (8)..(8): 2'-O-methyl-naphthyl-dU
  modified_base (9)..(9): 2'-O-methyl-g
  modified_base (10)..(10): 2'-O-methyl-naphthyl-dU
  modified_base (11)..(11): 2'-O-methyl-a
  modified_base (12)..(12): 2'-O-methyl-g
  modified_base (13)..(13): 2'-O-methyl-c
  modified_base (14)..(14): 2'-O-methyl-g
  modified_base (15)..(15): 2'-O-methyl-a
  modified_base (16)..(16): 2'-O-methyl-g
  modified_base (17)..(17): 2'-O-methyl-naphthyl-dU
  modified_base (18)..(18): 2'-O-methyl-g
  modified_base (19)..(19): 2'-O-methyl-c
  modified_base (20)..(20): 2'-O-methyl-g
  modified_base (21)..(21): 2'-O-methyl-naphthyl-dU
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-g
  modified_base (26)..(26): 2'-O-methyl-c
  modified_base (27)..(27): 2'-O-methyl-g
  modified_base (28)..(28): 2'-O-methyl-g
  modified_base (29)..(29): 2'-O-methyl-naphthyl-dU
gggguuauguagcgagugcguaaggcggu

SEQ ID NO: 507 - RNA, 29 nt, Artificial Sequence
  Description of Artificial Sequence: Synthetic oligonucleotide
  modified_base (1)..(1): 2'-O-methyl-g
  modified_base (2)..(2): 2'-O-methyl-g
  modified_base (3)..(3): 2'-O-methyl-g
  modified_base (4)..(4): 2'-O-methyl-g
  modified_base (5)..(5): 2'-O-methyl-u
  modified_base (6)..(6): 2'-O-methyl-u
  modified_base (7)..(7): 2'-O-methyl-a
  modified_base (8)..(8): 2'-O-methyl-u
  modified_base (9)..(9): 2'-O-methyl-g
  modified_base (10)..(10): 2'-O-methyl-u
  modified_base (11)..(11): 2'-O-methyl-a
  modified_base (12)..(12): 2'-O-methyl-g
  modified_base (13)..(13): 2'-O-methyl-c
  modified_base (14)..(14): 2'-O-methyl-g
  modified_base (15)..(15): 2'-O-methyl-a
  modified_base (16)..(16): 2'-O-methyl-g
  modified_base (17)..(17): 2'-O-methyl-u
  modified_base (18)..(18): 2'-O-methyl-g
  modified_base (19)..(19): 2'-O-methyl-c
  modified_base (20)..(20): 2'-O-methyl-g
  modified_base (21)..(21): 2'-O-methyl-u
  modified_base (22)..(22): 2'-O-methyl-a
  modified_base (23)..(23): 2'-O-methyl-a
  modified_base (24)..(24): 2'-O-methyl-g
  modified_base (25)..(25): 2'-O-methyl-g
  modified_base (26)..(26): 2'-O-methyl-c
  modified_base (27)..(27): 2'-O-methyl-g
  modified_base (28)..(28): 2'-O-methyl-g
  modified_base (29)..(29): 2'-O-methyl-u
gggguuauguagcgagugcguaaggcggu

SEQ ID NO: 508 - DNA, 26 bp, Artificial Sequence
  Description of Artificial Sequence: Synthetic oligonucleotide
  Description of Combined DNA/RNA Molecule: Synthetic oligonucleotide
  5'-C3 linker
  modified_base (2)..(2): 2'-O-methyl-g
  modified_base (4)..(4): naphthyl-dU
  modified_base (5)..(5): 2'-O-methyl-naphthyl-dU
  modified_base (7)..(7): naphthyl-dU
  modified_base (9)..(9): naphthyl-dU
  misc_feature (12)..(13): C3 linker between nucleotides-C3 linker between nucleotides
  modified_base (14)..(14): naphthyl-dU
  modified_base (15)..(15): 2'-O-methyl-g
  modified_base (18)..(18): naphthyl-dU
  modified_base (24)..(24): 2'-O-methyl-g
  modified_base (25)..(25): 2'-O-methyl-g
  modified_base (26)..(26): naphthyl-dU
ggguuauguagcgugcguaaggcggu

SEQ ID NO: 509 - DNA, 26 bp, Artificial Sequence
  Description of Artificial Sequence: Synthetic oligonucleotide
  Description of Combined DNA/RNA Molecule: Synthetic oligonucleotide
  5'-C3 linker
  modified_base (2)..(2): 2'-O-methyl-g
  modified_base (4)..(4): naphthyl-dU
  modified_base (5)..(5): naphthyl-dU
  modified_base (7)..(7): 2'-O-methyl-naphthyl-dU
  modified_base (9)..(9): naphthyl-dU
  misc_feature (12)..(13): C3 linker between nucleotides-C3 linker between nucleotides
  modified_base (14)..(14): naphthyl-dU
  modified_base (15)..(15): 2'-O-methyl-g
  modified_base (18)..(18): naphthyl-dU
  modified_base (24)..(24): 2'-O-methyl-g
  modified_base (25)..(25): 2'-O-methyl-g
  modified_base (26)..(26): naphthyl-dU
ggguuauguagcgugcguaaggcggu

SEQ ID NO: 510 - DNA, 26 bp, Artificial Sequence
  Description of Artificial Sequence: Synthetic oligonucleotide
  Description of Combined DNA/RNA Molecule: Synthetic oligonucleotide
  5'-C3 linker
  modified_base (2)..(2): 2'-O-methyl-g
  modified_base (4)..(4): naphthyl-dU
  modified_base (5)..(5): naphthyl-dU
  modified_base (7)..(7): 2'-O-methyl-naphthyl-dU
  modified_base (9)..(9): 2'-O-methyl-naphthyl-dU
  misc_feature (12)..(13): C3 linker between nucleotides-C3 linker between nucleotides
  modified_base (14)..(14): naphthyl-dU
  modified_base (15)..(15): 2'-O-methyl-g
  modified_base (18)..(18): naphthyl-dU
  modified_base (24)..(24): 2'-O-methyl-g
  modified_base (25)..(25): 2'-O-methyl-g
  modified_base (26)..(26): naphthyl-dU
ggguuauguagcgugcguaaggcggu

SEQ ID NO: 511 - DNA, 26 bp, Artificial Sequence
  Description of Artificial Sequence: Synthetic oligonucleotide
  Description of Combined DNA/RNA Molecule: Synthetic oligonucleotide
  5'-C3 linker
  modified_base (2)..(2): 2'-O-methyl-g
  modified_base (4)..(4): 2'-O-methyl-naphthyl-dU
  modified_base (5)..(5): 2'-O-methyl-naphthyl-dU
  modified_base (7)..(7): 2'-O-methyl-naphthyl-dU
  modified_base (9)..(9): naphthyl-dU
  misc_feature (12)..(13): C3 linker between nucleotides-C3 linker between nucleotides
  modified_base (14)..(14): naphthyl-dU
  modified_base (15)..(15): 2'-O-methyl-g
  modified_base (18)..(18): naphthyl-dU
  modified_base (24)..(24): 2'-O-methyl-g
  modified_base (25)..(25): 2'-O-methyl-g
  modified_base (26)..(26): naphthyl-dU
ggguuauguagcgugcguaaggcggu

SEQ ID NO: 512 - DNA, 25 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl-g
  modified_base (3)..(3): naphthyl-dU
  modified_base (4)..(4): naphthyl-dU
  modified_base (6)..(6): naphthyl-dU
  modified_base (8)..(8): naphthyl-dU
  misc_feature (11)..(12): C3 linker between nucleotides-C3 linker between nucleotides
  modified_base (13)..(13): naphthyl-dU
  modified_base (14)..(14): 2'-O-methyl-g
  modified_base (17)..(17): naphthyl-dU
  modified_base (23)..(23): 2'-O-methyl-g
  modified_base (24)..(24): 2'-O-methyl-g
  modified_base (25)..(25): naphthyl-dU
gguuauguagcgugcguaaggcggu

SEQ ID NO: 513 - DNA, 26 bp, Artificial Sequence
  Description of Artificial Sequence: Synthetic oligonucleotide
  Description of Combined DNA/RNA Molecule: Synthetic oligonucleotide
  5'-C3 linker
  modified_base (2)..(2): 2'-O-methyl-g
  modified_base (4)..(4): 2'-O-methyl-naphthyl-dU
  modified_base (5)..(5): 2'-O-methyl-naphthyl-dU
  modified_base (7)..(7): 2'-O-methyl-naphthyl-dU
  modified_base (9)..(9): 2'-O-methyl-naphthyl-dU
  misc_feature (12)..(13): C3 linker between nucleotides-C3 linker between nucleotides
  modified_base (14)..(14): 2'-O-methyl-naphthyl-dU
  modified_base (15)..(15): 2'-O-methyl-g
  modified_base (18)..(18): 2'-O-methyl-naphthyl-dU
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 514 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-u
  modified_base (5)..(5): naphthyl-dU
  modified_base (7)..(7): naphthyl-dU
  modified_base (9)..(9): naphthyl-dU
  misc_feature (12)..(13): C3 linker between nucleotides-C3 linker between nucleotides
  modified_base (14)..(14): naphthyl-dU
  modified_base (15)..(15): 2'-O-methyl-g
  modified_base (18)..(18): naphthyl-dU
  modified_base (24)..(24): 2'-O-methyl-g
  modified_base (25)..(25): 2'-O-methyl-g
  modified_base (26)..(26): naphthyl-dU
ggguuauguagcgugcguaaggcggu

SEQ ID NO: 515 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): naphthyl-dU
  modified_base (5)..(5): 2'-O-methyl-u
  modified_base (7)..(7): naphthyl-dU
  modified_base (9)..(9): naphthyl-dU
  misc_feature (12)..(13): C3 linker between nucleotides-C3 linker between nucleotides
  modified_base (14)..(14): naphthyl-dU
  modified_base (15)..(15): 2'-O-methyl-g
  modified_base (18)..(18): naphthyl-dU
  modified_base (24)..(24): 2'-O-methyl-g
  modified_base (25)..(25): 2'-O-methyl-g
  modified_base (26)..(26): naphthyl-dU
ggguuauguagcgugcguaaggcggu

SEQ ID NO: 516 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): naphthyl-dU
  modified_base (5)..(5): naphthyl-dU
  modified_base (7)..(7): 2'-O-methyl-u
  modified_base (9)..(9): naphthyl-dU
  misc_feature (12)..(13): C3 linker between nucleotides-C3 linker between nucleotides
  modified_base (14)..(14): naphthyl-dU
  modified_base (15)..(15): 2'-O-methyl-g
  modified_base (18)..(18): naphthyl-dU
  modified_base (24)..(24): 2'-O-methyl-g
  modified_base (25)..(25): 2'-O-methyl-g
  modified_base (26)..(26): naphthyl-dU
ggguuauguagcgugcguaaggcggu

SEQ ID NO: 517 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): naphthyl-dU
  modified_base (5)..(5): naphthyl-dU
  modified_base (7)..(7): naphthyl-dU
  modified_base (9)..(9): 2'-O-methyl-u
  misc_feature (12)..(13): C3 linker between nucleotides-C3 linker between nucleotides
  modified_base (14)..(14): naphthyl-dU
  modified_base (15)..(15): 2'-O-methyl-g
  modified_base (18)..(18): naphthyl-dU
  modified_base (24)..(24): 2'-O-methyl-g
  modified_base (25)..(25): 2'-O-methyl-g
  modified_base (26)..(26): naphthyl-dU
ggguuauguagcgugcguaaggcggu

SEQ ID NO: 518 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): naphthyl-dU
  modified_base (5)..(5): naphthyl-dU
  modified_base (7)..(7): naphthyl-dU
  modified_base (9)..(9): naphthyl-dU
  misc_feature (12)..(13): C3 linker between nucleotides-C3 linker between nucleotides
  modified_base (14)..(14): naphthyl-dU
  modified_base (15)..(15): 2'-O-methyl-g
  modified_base (18)..(18): 2'-O-methyl-u
  modified_base (24)..(24): 2'-O-methyl-g
  modified_base (25)..(25): 2'-O-methyl-g
  modified_base (26)..(26): naphthyl-dU
ggguuauguagcgugcguaaggcggu

SEQ ID NO: 519 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): naphthyl-dU
  modified_base (5)..(5): naphthyl-dU
  modified_base (7)..(7): naphthyl-dU
  modified_base (9)..(9): naphthyl-dU
  misc_feature (12)..(13): C3 linker between nucleotides-C3 linker between nucleotides
  modified_base (14)..(14): naphthyl-dU
  modified_base (15)..(15): 2'-O-methyl-g
  modified_base (18)..(18): naphthyl-dU
  modified_base (24)..(24): 2'-O-methyl-g
  modified_base (25)..(25): 2'-O-methyl-g
  modified_base (26)..(26): 2'-O-methyl-u
ggguuauguagcgugcguaaggcggu

SEQ ID NO: 520 - DNA, 26 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl-g
  modified_base (2)..(2): 2'-O-methyl-g
  modified_base (3)..(3): 2'-O-methyl-g
  modified_base (4)..(4): 2'-O-methyl-naphthyl-dU
  modified_base (5)..(5): 2'-O-methyl-naphthyl-dU
  modified_base (6)..(6): 2'-O-methyl-a
  modified_base (7)..(7): 2'-O-methyl-naphthyl-dU
  modified_base (8)..(8): 2'-O-methyl-g
  modified_base (9)..(9): 2'-O-methyl-naphthyl-dU
  modified_base (10)..(10): 2'-O-methyl-a
  modified_base (11)..(11): 2'-O-methyl-g
  modified_base (12)..(12): 2'-O-methyl-c
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (16)..(16): 2'-O-methyl-c
  modified_base (17)..(17): 2'-O-methyl-g
  modified_base (18)..(18): 2'-O-methyl-naphthyl-dU
  modified_base (19)..(19): 2'-O-methyl-a
  modified_base (20)..(20): 2'-O-methyl-a
  modified_base (21)..(21): 2'-O-methyl-g
  modified_base (22)..(22): 2'-O-methyl-g
  modified_base (23)..(23): 2'-O-methyl-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 521 - DNA, 26 bp, Artificial Sequence
  Description of Artificial Sequence: Synthetic oligonucleotide
  Description of Combined DNA/RNA Molecule: Synthetic oligonucleotide
  modified_base (1)..(1): 2'-fluoro-g
  modified_base (2)..(2): 2'-fluoro-g
  modified_base (3)..(3): 2'-fluoro-g
  modified_base (4)..(4): 2'-O-methyl-naphthyl-dU
  modified_base (5)..(5): 2'-O-methyl-naphthyl-dU
  modified_base (6)..(6): 2'-fluoro-a
  modified_base (7)..(7): 2'-O-methyl-naphthyl-dU
  modified_base (8)..(8): 2'-fluoro-g
  modified_base (9)..(9): 2'-O-methyl-naphthyl-dU
  modified_base (10)..(10): 2'-fluoro-a
  modified_base (11)..(11): 2'-fluoro-g
  modified_base (12)..(12): 2'-fluoro-c
  misc_feature (12)..(13): C3 linker between nucleotides-C3 linker between nucleotides
  modified_base (13)..(13): 2'-fluoro-g
  modified_base (14)..(14): 2'-O-methyl-u
  modified_base (15)..(15): 2'-fluoro-g
  modified_base (16)..(16): 2'-fluoro-c
  modified_base (17)..(17): 2'-fluoro-g
  modified_base (18)..(18): 2'-O-methyl-naphthyl-dU
  modified_base (19)..(19): 2'-fluoro-a
  modified_base (20)..(20): 2'-fluoro-a
  modified_base (21)..(21): 2'-fluoro-g
  modified_base (22)..(22): 2'-fluoro-g
  modified_base (23)..(23): 2'-fluoro-c
  modified_base (24)..(24): 2'-fluoro-g
  modified_base (25)..(25): 2'-fluoro-g
  modified_base (26)..(26): 2'-O-methyl-naphthyl-dU
ggguuauguagcgugcguaaggcggu

SEQ ID NO: 522 - DNA, 28 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl-g
  modified_base (2)..(2): 2'-O-methyl-g
  modified_base (3)..(3): 2'-O-methyl-g
  modified_base (4)..(4): 2'-O-methyl-naphthyl-dU
  modified_base (5)..(5): 2'-O-methyl-naphthyl-dU
  modified_base (6)..(6): 2'-O-methyl-a
  modified_base (7)..(7): 2'-O-methyl-naphthyl-dU
  modified_base (8)..(8): 2'-O-methyl-g
  modified_base (9)..(9): 2'-O-methyl-naphthyl-dU
  modified_base (10)..(10): 2'-O-methyl-a
  modified_base (11)..(11): 2'-O-methyl-g
  modified_base (12)..(12): 2'-O-methyl-c
  modified_base (13)..(13): 2'-O-methyl-g
  modified_base (14)..(14): 2'-O-methyl-a
  modified_base (15)..(15): 2'-O-methyl-g
  modified_base (16)..(16): 2'-O-methyl-u
  modified_base (17)..(17): 2'-O-methyl-g
  modified_base (18)..(18): 2'-O-methyl-c
  modified_base (19)..(19): 2'-O-methyl-g
  modified_base (20)..(20): 2'-O-methyl-naphthyl-dU
  modified_base (21)..(21): 2'-O-methyl-a
  modified_base (22)..(22): 2'-O-methyl-a
  modified_base (23)..(23): 2'-O-methyl-g
  modified_base (24)..(24): 2'-O-methyl-g
  modified_base (25)..(25): 2'-O-methyl-c
  modified_base (26)..(26): 2'-O-methyl-g
  modified_base (27)..(27): 2'-O-methyl-g
  modified_base (28)..(28): 2'-O-methyl-naphthyl-dU
ggguuauguagcgagugcguaaggcggu

SEQ ID NO: 523 - DNA, 26 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl-g
  modified_base (2)..(2): 2'-O-methyl-g
  modified_base (3)..(3): 2'-O-methyl-g
  modified_base (4)..(4): 2'-O-methyl-naphthyl-dU
  modified_base (5)..(5): phosphorothioate-(deoxyribose)-naphthyl-dU
  modified_base (6)..(6): 2'-O-methyl-a
  modified_base (7)..(7): phosphorothioate-(deoxyribose)-naphthyl-dU
  modified_base (8)..(8): 2'-O-methyl-g
  modified_base (9)..(9): 2'-O-methyl-naphthyl-dU
  modified_base (10)..(10): 2'-O-methyl-a
  modified_base (11)..(11): 2'-O-methyl-g
  modified_base (12)..(12): 2'-O-methyl-c
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (16)..(16): 2'-O-methyl-c
  modified_base (17)..(17): 2'-O-methyl-g
  modified_base (18)..(18): 2'-O-methyl-naphthyl-dU
  modified_base (19)..(19): 2'-O-methyl-a
  modified_base (20)..(20): 2'-O-methyl-a
  modified_base (21)..(21): 2'-O-methyl-g
  modified_base (22)..(22): 2'-O-methyl-g
  modified_base (23)..(23): 2'-O-methyl-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 524 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (7)..(7): phosphorothioate-(deoxyribose)-naphthyl-dU
  modified_base (9)..(9): 2'-O-methyl-naphthyl-dU
  modified_base (11)..(11): 2'-O-methyl-g
  modified_base (12)..(12): 2'-O-methyl-c
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-naphthyl-dU
  modified_base (19)..(19): 2'-O-methyl-a
  modified_base (22)..(22): phosphorothioate-(deoxyribose)-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 525 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-morpholinoethyl-dU
  modified_base (5)..(5): phosphorothioate-(deoxyribose)-naphthyl-dU
  modified_base (7)..(7): phosphorothioate-(deoxyribose)-naphthyl-dU
  modified_base (9)..(9): 2'-O-methyl-naphthyl-dU
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-naphthyl-dU
  modified_base (22)..(22): phosphorothioate-(deoxyribose)-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 526 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (7)..(7): phosphorothioate-(deoxyribose)-naphthyl-dU
  modified_base (9)..(9): 2'-O-methyl-naphthyl-dU
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-morpholinoethyl-dU
  modified_base (22)..(22): phosphorothioate-(deoxyribose)-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 527 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (7)..(7): phosphorothioate-(deoxyribose)-naphthyl-dU
  modified_base (9)..(9): 2'-O-methyl-naphthyl-dU
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-naphthyl-dU
  modified_base (22)..(22): phosphorothioate-(deoxyribose)-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-morpholinoethyl-dU
ggguuauguagcgugcguaaggcggu

SEQ ID NO: 528 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-morpholinoethyl-dU
  modified_base (7)..(7): phosphorothioate-(deoxyribose)-naphthyl-dU
  modified_base (9)..(9): 2'-O-methyl-naphthyl-dU
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-naphthyl-dU
  modified_base (22)..(22): phosphorothioate-(deoxyribose)-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 529 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (7)..(7): phosphorothioate-(deoxyribose)-morpholinoethyl-dU
  modified_base (9)..(9): 2'-O-methyl-naphthyl-dU
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-naphthyl-dU
  modified_base (22)..(22): phosphorothioate-(deoxyribose)-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 530 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-R-tetrahydrofuranyl-dU
  modified_base (5)..(5): phosphorothioate-(deoxyribose)-naphthyl-dU
  modified_base (7)..(7): phosphorothioate-(deoxyribose)-naphthyl-dU
  modified_base (9)..(9): 2'-O-methyl-naphthyl-dU
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-naphthyl-dU
  modified_base (22)..(22): phosphorothioate-(deoxyribose)-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 531 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (7)..(7): phosphorothioate-(deoxyribose)-naphthyl-dU
  modified_base (9)..(9): 2'-O-methyl-naphthyl-dU
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-R-tetrahydrofuranyl-dU
  modified_base (22)..(22): phosphorothioate-(deoxyribose)-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 532 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (7)..(7): phosphorothioate-(deoxyribose)-naphthyl-dU
  modified_base (9)..(9): 2'-O-methyl-naphthyl-dU
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-naphthyl-dU
  modified_base (22)..(22): phosphorothioate-(deoxyribose)-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-R-tetrahydrofuranyl-dU
ggguuauguagcgugcguaaggcggu

SEQ ID NO: 533 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (7)..(7): phosphorothioate-(deoxyribose)-naphthyl-dU
  modified_base (9)..(9): 2'-O-methyl-pyridyl-dU
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-naphthyl-dU
  modified_base (22)..(22): phosphorothioate-(deoxyribose)-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 534 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (7)..(7): phosphorothioate-(deoxyribose)-naphthyl-dU
  modified_base (9)..(9): 2'-O-methyl-naphthyl-dU
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-naphthyl-dU
  modified_base (22)..(22): phosphorothioate-(deoxyribose)-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-pyridyl-dU
ggguuauguagcgugcguaaggcggu

SEQ ID NO: 535 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-pyridyl-dU
  modified_base (7)..(7): phosphorothioate-(deoxyribose)-naphthyl-dU
  modified_base (9)..(9): 2'-O-methyl-naphthyl-dU
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-naphthyl-dU
  modified_base (22)..(22): phosphorothioate-(deoxyribose)-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 536 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (7)..(7): phosphorothioate-(deoxyribose)-pyridyl-dU
  modified_base (9)..(9): 2'-O-methyl-naphthyl-dU
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-naphthyl-dU
  modified_base (22)..(22): phosphorothioate-(deoxyribose)-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 537 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-methylenedioxybenzyl-dU
  modified_base (7)..(7): phosphorothioate-(deoxyribose)-naphthyl-dU
  modified_base (9)..(9): 2'-O-methyl-naphthyl-dU
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-naphthyl-dU
  modified_base (22)..(22): phosphorothioate-(deoxyribose)-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 538 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (7)..(7): phosphorothioate-(deoxyribose)-methylenedioxybenzyl-dU
  modified_base (9)..(9): 2'-O-methyl-naphthyl-dU
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-naphthyl-dU
  modified_base (22)..(22): phosphorothioate-(deoxyribose)-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 539 - DNA, 26 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl-g
  modified_base (2)..(2): 2'-O-methyl-g
  modified_base (3)..(3): 2'-O-methyl-g
  modified_base (4)..(4): 2'-O-methyl-naphthyl-dU
  modified_base (5)..(5): phosphorothioate-(deoxyribose)-naphthyl-dU
  modified_base (7)..(7): phosphorothioate-(deoxyribose)-naphthyl-dU
  modified_base (9)..(9): 2'-O-methyl-naphthyl-dU
  modified_base (11)..(11): 2'-O-methyl-g
  modified_base (12)..(12): 2'-O-methyl-c
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-naphthyl-dU
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 540 - DNA, 26 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl-g
  modified_base (2)..(2): 2'-O-methyl-g
  modified_base (3)..(3): 2'-O-methyl-g
  modified_base (4)..(4): 2'-O-methyl-naphthyl-dU
  modified_base (5)..(5): phosphorothioate-(deoxyribose)-naphthyl-dU
  modified_base (7)..(7): phosphorothioate-(deoxyribose)-naphthyl-dU
  modified_base (8)..(8): 2'-O-methyl-g
  modified_base (9)..(9): 2'-O-methyl-naphthyl-dU
  modified_base (11)..(11): 2'-O-methyl-g
  modified_base (12)..(12): 2'-O-methyl-c
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-naphthyl-dU
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 541 - DNA, 26 bp, Artificial Sequence
  Description of Artificial Sequence: Synthetic oligonucleotide
  Description of Combined DNA/RNA Molecule: Synthetic oligonucleotide
  modified_base (1)..(1): phosphorothioate-(deoxyribose)-g
  modified_base (2)..(2): 2'-O-methyl-g
  modified_base (3)..(3): phosphorothioate-(deoxyribose)-g
  modified_base (4)..(4): 2'-O-methyl-naphthyl-dU
  modified_base (5)..(5): phosphorothioate-(deoxyribose)-naphthyl-dU
  modified_base (6)..(6): phosphorothioate-(deoxyribose)-a
  modified_base (7)..(7): phosphorothioate-(deoxyribose)-naphthyl-dU
  modified_base (8)..(8): phosphorothioate-(deoxyribose)-g
  modified_base (9)..(9): 2'-O-methyl-naphthyl-dU
  modified_base (10)..(10): phosphorothioate-(deoxyribose)-a
  modified_base (11)..(11): 2'-O-methyl-g
  modified_base (12)..(12): 2'-O-methyl-c
  misc_feature (12)..(13): phosphorothioate-C3-phosphorothioate-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (16)..(16): phosphorothioate-(deoxyribose)-c
  modified_base (17)..(17): phosphorothioate-(deoxyribose)-g
  modified_base (18)..(18): 2'-O-methyl-naphthyl-dU
  modified_base (19)..(19): phosphorothioate-(deoxyribose)-a
  modified_base (20)..(20): phosphorothioate-(deoxyribose)-a
  modified_base (21)..(21): phosphorothioate-(deoxyribose)-g
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 542 - DNA, 26 bp, Artificial Sequence
  Description of Artificial Sequence: Synthetic oligonucleotide
  Description of Combined DNA/RNA Molecule: Synthetic oligonucleotide
  modified_base (1)..(1): phosphorothioate-(deoxyribose)-g
  modified_base (2)..(2): 2'-O-methyl-g
  modified_base (3)..(3): phosphorothioate-(deoxyribose)-g
  modified_base (4)..(4): 2'-O-methyl-naphthyl-dU
  modified_base (5)..(5): phosphorothioate-(deoxyribose)-naphthyl-dU
  modified_base (6)..(6): phosphorothioate-(deoxyribose)-a
  modified_base (7)..(7): phosphorothioate-(deoxyribose)-naphthyl-dU
  modified_base (8)..(8): phosphorothioate-(deoxyribose)-g
  modified_base (9)..(9): 2'-O-methyl-naphthyl-dU
  modified_base (10)..(10): phosphorothioate-(deoxyribose)-a
  modified_base (11)..(11): 2'-O-methyl-g
  modified_base (12)..(12): 2'-O-methyl-c
  misc_feature (12)..(13): phosphorothioate-C3-phosphorothioate-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (16)..(16): phosphorothioate-(deoxyribose)-c
  modified_base (17)..(17): phosphorothioate-(deoxyribose)-g
  modified_base (18)..(18): 2'-O-methyl-naphthyl-dU
  modified_base (19)..(19): phosphorothioate-(deoxyribose)-a
  modified_base (20)..(20): phosphorothioate-(deoxyribose)-a
  modified_base (21)..(21): phosphorothioate-(deoxyribose)-g
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 543 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (7)..(7): phosphorothioate-(deoxyribose)-naphthyl-dU
  modified_base (9)..(9): 2'-O-methyl-naphthyl-dU
  modified_base (11)..(11): 2'-O-methyl-g
  modified_base (12)..(12): 2'-O-methyl-c
  misc_feature (12)..(13): phosphorothioate-C3-phosphorothioate-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (18)..(18): 2'-O-methyl-naphthyl-dU
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 544 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (6)..(6): phosphorothioate-(deoxyribose)-a
  modified_base (7)..(7): phosphorothioate-(deoxyribose)-naphthyl-dU
  modified_base (8)..(8): 2'-O-methyl-g
  modified_base (9)..(9): 2'-O-methyl-naphthyl-dU
  modified_base (10)..(10): phosphorothioate-(deoxyribose)-a
  modified_base (11)..(11): 2'-O-methyl-g
  modified_base (12)..(12): 2'-O-methyl-c
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (16)..(16): phosphorothioate-(deoxyribose)-c
  modified_base (17)..(17): phosphorothioate-(deoxyribose)-g
  modified_base (18)..(18): 2'-O-methyl-naphthyl-dU
  modified_base (19)..(19): phosphorothioate-(deoxyribose)-a
  modified_base (20)..(20): phosphorothioate-(deoxyribose)-a
  modified_base (21)..(21): phosphorothioate-(deoxyribose)-g
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 545 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (6)..(6): phosphorothioate-(deoxyribose)-a
  modified_base (7)..(7): phosphorothioate-(deoxyribose)-naphthyl-dU
  modified_base (8)..(8): 2'-O-methyl-g
  modified_base (9)..(9): 2'-O-methyl-naphthyl-dU
  modified_base (10)..(10): phosphorothioate-(deoxyribose)-a
  modified_base (11)..(11): 2'-O-methyl-g
  modified_base (12)..(12): 2'-O-methyl-c
  misc_feature (12)..(13): phosphorothioate-C3-phosphorothioate-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (16)..(16): phosphorothioate-(deoxyribose)-c
  modified_base (17)..(17): phosphorothioate-(deoxyribose)-g
  modified_base (18)..(18): 2'-O-methyl-naphthyl-dU
  modified_base (19)..(19): phosphorothioate-(deoxyribose)-a
  modified_base (20)..(20): phosphorothioate-(deoxyribose)-a
  modified_base (21)..(21): phosphorothioate-(deoxyribose)-g
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 546 - DNA, 26 bp, Artificial Sequence
  Description of Artificial Sequence: Synthetic oligonucleotide
  Description of Combined DNA/RNA Molecule: Synthetic oligonucleotide
  modified_base (1)..(1): phosphorothioate-(deoxyribose)-g
  modified_base (2)..(2): 2'-O-methyl-g
  modified_base (3)..(3): phosphorothioate-(deoxyribose)-g
  modified_base (4)..(4): 2'-O-methyl-naphthyl-dU
  modified_base (5)..(5): phosphorothioate-(deoxyribose)-naphthyl-dU
  modified_base (6)..(6): phosphorothioate-(deoxyribose)-a
  modified_base (7)..(7): phosphorothioate-(deoxyribose)-naphthyl-dU
  modified_base (8)..(8): 2'-O-methyl-g
  modified_base (9)..(9): 2'-O-methyl-naphthyl-dU
  modified_base (10)..(10): phosphorothioate-(deoxyribose)-a
  modified_base (11)..(11): 2'-O-methyl-g
  modified_base (12)..(12): 2'-O-methyl-c
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (16)..(16): phosphorothioate-(deoxyribose)-c
  modified_base (17)..(17): phosphorothioate-(deoxyribose)-g
  modified_base (18)..(18): 2'-O-methyl-naphthyl-dU
  modified_base (19)..(19): phosphorothioate-(deoxyribose)-a
  modified_base (20)..(20): phosphorothioate-(deoxyribose)-a
  modified_base (21)..(21): phosphorothioate-(deoxyribose)-g
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 547 - DNA, 26 bp, Artificial Sequence
  Description of Artificial Sequence: Synthetic oligonucleotide
  Description of Combined DNA/RNA Molecule: Synthetic oligonucleotide
  modified_base (1)..(1): phosphorothioate-(deoxyribose)-g
  modified_base (2)..(2): 2'-O-methyl-g
  modified_base (3)..(3): phosphorothioate-(deoxyribose)-g
  modified_base (4)..(4): 2'-O-methyl-naphthyl-dU
  modified_base (5)..(5): phosphorothioate-(deoxyribose)-naphthyl-dU
  modified_base (6)..(6): phosphorothioate-(deoxyribose)-a
  modified_base (7)..(7): phosphorothioate-(deoxyribose)-naphthyl-dU
  modified_base (8)..(8): 2'-O-methyl-g
  modified_base (9)..(9): 2'-O-methyl-naphthyl-dU
  modified_base (10)..(10): phosphorothioate-(deoxyribose)-a
  modified_base (11)..(11): 2'-O-methyl-g
  modified_base (12)..(12): 2'-O-methyl-c
  misc_feature (12)..(13): phosphorothioate-C3-phosphorothioate-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (16)..(16): phosphorothioate-(deoxyribose)-c
  modified_base (17)..(17): phosphorothioate-(deoxyribose)-g
  modified_base (18)..(18): 2'-O-methyl-naphthyl-dU
  modified_base (19)..(19): phosphorothioate-(deoxyribose)-a
  modified_base (20)..(20): phosphorothioate-(deoxyribose)-a
  modified_base (21)..(21): phosphorothioate-(deoxyribose)-g
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 548 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (6)..(6): phosphorothioate-(deoxyribose)-a
  modified_base (7)..(7): phosphorothioate-(deoxyribose)-naphthyl-dU
  modified_base (8)..(8): 2'-O-methyl-g
  modified_base (9)..(9): 2'-O-methyl-morpholinoethyl-dU
  modified_base (10)..(10): phosphorothioate-(deoxyribose)-a
  modified_base (11)..(11): 2'-O-methyl-g
  modified_base (12)..(12): 2'-O-methyl-c
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (16)..(16): phosphorothioate-(deoxyribose)-c
  modified_base (17)..(17): phosphorothioate-(deoxyribose)-g
  modified_base (18)..(18): 2'-O-methyl-naphthyl-dU
  modified_base (19)..(19): phosphorothioate-(deoxyribose)-a
  modified_base (20)..(20): phosphorothioate-(deoxyribose)-a
  modified_base (21)..(21): phosphorothioate-(deoxyribose)-g
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 549 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (6)..(6): phosphorothioate-(deoxyribose)-a
  modified_base (7)..(7): phosphorothioate-(deoxyribose)-naphthyl-dU
  modified_base (8)..(8): 2'-O-methyl-g
  modified_base (9)..(9): 2'-O-methyl-morpholinoethyl-dU
  modified_base (10)..(10): phosphorothioate-(deoxyribose)-a
  modified_base (11)..(11): 2'-O-methyl-g
  modified_base (12)..(12): 2'-O-methyl-c
  misc_feature (12)..(13): C3 linker between nucleotides-C3 linker between nucleotides
  modified_base (13)..(13): 2'-O-methyl-g
  modified_base (14)..(14): 2'-O-methyl-morpholinoethyl-dU
  modified_base (15)..(15): 2'-O-methyl-g
  modified_base (16)..(16): phosphorothioate-(deoxyribose)-c
  modified_base (17)..(17): phosphorothioate-(deoxyribose)-g
  modified_base (18)..(18): 2'-O-methyl-naphthyl-dU
  modified_base (19)..(19): phosphorothioate-(deoxyribose)-a
  modified_base (20)..(20): phosphorothioate-(deoxyribose)-a
  modified_base (21)..(21): phosphorothioate-(deoxyribose)-g
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 550 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-pyridyl-dU
  modified_base (5)..(5): phosphorothioate-(deoxyribose)-naphthyl-dU
  modified_base (6)..(6): phosphorothioate-(deoxyribose)-a
  modified_base (7)..(7): phosphorothioate-(deoxyribose)-naphthyl-dU
  modified_base (8)..(8): 2'-O-methyl-g
  modified_base (9)..(9): 2'-O-methyl-morpholinoethyl-dU
  modified_base (10)..(10): phosphorothioate-(deoxyribose)-a
  modified_base (11)..(11): 2'-O-methyl-g
  modified_base (12)..(12): 2'-O-methyl-c
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (16)..(16): phosphorothioate-(deoxyribose)-c
  modified_base (17)..(17): phosphorothioate-(deoxyribose)-g
  modified_base (18)..(18): 2'-O-methyl-naphthyl-dU
  modified_base (19)..(19): phosphorothioate-(deoxyribose)-a
  modified_base (20)..(20): phosphorothioate-(deoxyribose)-a
  modified_base (21)..(21): phosphorothioate-(deoxyribose)-g
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 551 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (6)..(6): phosphorothioate-(deoxyribose)-a
  modified_base (7)..(7): phosphorothioate-(deoxyribose)-naphthyl-dU
  modified_base (8)..(8): 2'-O-methyl-g
  modified_base (9)..(9): 2'-O-methyl-morpholinoethyl-dU
  modified_base (10)..(10): phosphorothioate-(deoxyribose)-a
  modified_base (11)..(11): 2'-O-methyl-g
  modified_base (12)..(12): 2'-O-methyl-c
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (16)..(16): phosphorothioate-(deoxyribose)-c
  modified_base (17)..(17): phosphorothioate-(deoxyribose)-g
  modified_base (18)..(18): 2'-O-methyl-pyridyl-dU
  modified_base (19)..(19): phosphorothioate-(deoxyribose)-a
  modified_base (20)..(20): phosphorothioate-(deoxyribose)-a
  modified_base (21)..(21): phosphorothioate-(deoxyribose)-g
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 552 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-pyridyl-dU
  modified_base (5)..(5): phosphorothioate-(deoxyribose)-naphthyl-dU
  modified_base (6)..(6): phosphorothioate-(deoxyribose)-a
  modified_base (7)..(7): phosphorothioate-(deoxyribose)-naphthyl-dU
  modified_base (8)..(8): 2'-O-methyl-g
  modified_base (9)..(9): 2'-O-methyl-morpholinoethyl-dU
  modified_base (10)..(10): phosphorothioate-(deoxyribose)-a
  modified_base (11)..(11): 2'-O-methyl-g
  modified_base (12)..(12): 2'-O-methyl-c
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (16)..(16): phosphorothioate-(deoxyribose)-c
  modified_base (17)..(17): phosphorothioate-(deoxyribose)-g
  modified_base (18)..(18): 2'-O-methyl-pyridyl-dU
  modified_base (19)..(19): phosphorothioate-(deoxyribose)-a
  modified_base (20)..(20): phosphorothioate-(deoxyribose)-a
  modified_base (21)..(21): phosphorothioate-(deoxyribose)-g
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 553 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-pyridyl-dU
  modified_base (5)..(5): phosphorothioate-(deoxyribose)-naphthyl-dU
  modified_base (6)..(6): phosphorothioate-(deoxyribose)-a
  modified_base (7)..(7): phosphorothioate-(deoxyribose)-naphthyl-dU
  modified_base (8)..(8): 2'-O-methyl-g
  modified_base (9)..(9): 2'-O-methyl-morpholinoethyl-dU
  modified_base (10)..(10): phosphorothioate-(deoxyribose)-a
  modified_base (11)..(11): 2'-O-methyl-g
  modified_base (12)..(12): 2'-O-methyl-c
  misc_feature (12)..(13): C3 linker between nucleotides-C3 linker between nucleotides
  modified_base (13)..(13): 2'-O-methyl-g
  modified_base (14)..(14): 2'-O-methyl-morpholinoethyl-dU
  modified_base (15)..(15): 2'-O-methyl-g
  modified_base (16)..(16): phosphorothioate-(deoxyribose)-c
  modified_base (17)..(17): phosphorothioate-(deoxyribose)-g
  modified_base (18)..(18): 2'-O-methyl-pyridyl-dU
  modified_base (19)..(19): phosphorothioate-(deoxyribose)-a
  modified_base (20)..(20): phosphorothioate-(deoxyribose)-a
  modified_base (21)..(21): phosphorothioate-(deoxyribose)-g
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 554 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-pyridyl-dU
  modified_base (5)..(5): phosphorothioate-(deoxyribose)-naphthyl-dU
  modified_base (6)..(6): phosphorothioate-(deoxyribose)-a
  modified_base (7)..(7): phosphorothioate-(deoxyribose)-naphthyl-dU
  modified_base (8)..(8): 2'-O-methyl-g
  modified_base (9)..(9): 2'-O-methyl-morpholinoethyl-dU
  modified_base (10)..(10): phosphorothioate-(deoxyribose)-a
  modified_base (11)..(11): 2'-O-methyl-g
  modified_base (12)..(12): 2'-O-methyl-c
  misc_feature (12)..(13): C3 linker between nucleotides-C3 linker between nucleotides
  modified_base (13)..(13): 2'-O-methyl-g
  modified_base (14)..(14): 2'-O-methyl-morpholinoethyl-dU
  modified_base (15)..(15): 2'-O-methyl-g
  modified_base (16)..(16): phosphorothioate-(deoxyribose)-c
  modified_base (17)..(17): phosphorothioate-(deoxyribose)-g
  modified_base (18)..(18): 2'-O-methyl-pyridyl-dU
  modified_base (19)..(19): phosphorothioate-(deoxyribose)-a
  modified_base (20)..(20): phosphorothioate-(deoxyribose)-a
  modified_base (21)..(21): phosphorothioate-(deoxyribose)-g
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-methylenedioxybenzyl-dU
ggguuauguagcgugcguaaggcggu

SEQ ID NO: 555 - DNA, 26 bp, Artificial Sequence
  Description of Artificial Sequence: Synthetic oligonucleotide
  Description of Combined DNA/RNA Molecule: Synthetic oligonucleotide
  modified_base (2)..(2): 2'-O-methyl-g
  modified_base (4)..(4): 2'-O-methyl-naphthyl-dU
  modified_base (5)..(5): phosphorothioate-(deoxyribose)-naphthyl-dU
  modified_base (6)..(6): phosphorothioate-(deoxyribose)-a
  modified_base (7)..(7): phosphorothioate-(deoxyribose)-naphthyl-dU
  modified_base (8)..(8): 2'-O-methyl-g
  modified_base (9)..(9): 2'-O-methyl-naphthyl-dU
  modified_base (10)..(10): phosphorothioate-(deoxyribose)-a
  modified_base (11)..(11): 2'-O-methyl-g
  modified_base (12)..(12): 2'-O-methyl-c
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (16)..(16): phosphorothioate-(deoxyribose)-c
  modified_base (17)..(17): phosphorothioate-(deoxyribose)-g
  modified_base (18)..(18): 2'-O-methyl-naphthyl-dU
  modified_base (19)..(19): phosphorothioate-(deoxyribose)-a
  modified_base (20)..(20): phosphorothioate-(deoxyribose)-a
  modified_base (21)..(21): phosphorothioate-(deoxyribose)-g
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-methylenedioxybenzyl-dU
ggguuauguagcgugcguaaggcggu

SEQ ID NO: 556 - DNA, 26 bp, Artificial Sequence
  Description of Artificial Sequence: Synthetic oligonucleotide
  Description of Combined DNA/RNA Molecule: Synthetic oligonucleotide
  modified_base (1)..(1): phosphorothioate-(deoxyribose)-g
  modified_base (2)..(2): 2'-O-methyl-g
  modified_base (3)..(3): phosphorothioate-(deoxyribose)-g
  modified_base (4)..(4): 2'-O-methyl-naphthyl-dU
  modified_base (5)..(5): phosphorothioate-(deoxyribose)-naphthyl-dU
  modified_base (6)..(6): phosphorothioate-(deoxyribose)-a
  modified_base (7)..(7): phosphorothioate-(deoxyribose)-naphthyl-dU
  modified_base (8)..(8): 2'-O-methyl-g
  modified_base (9)..(9): 2'-O-methyl-morpholinoethyl-dU
  modified_base (10)..(10): phosphorothioate-(deoxyribose)-a
  modified_base (11)..(11): 2'-O-methyl-g
  modified_base (12)..(12): 2'-O-methyl-c
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (16)..(16): phosphorothioate-(deoxyribose)-c
  modified_base (17)..(17): phosphorothioate-(deoxyribose)-g
  modified_base (18)..(18): 2'-O-methyl-naphthyl-dU
  modified_base (19)..(19): phosphorothioate-(deoxyribose)-a
  modified_base (20)..(20): phosphorothioate-(deoxyribose)-a
  modified_base (21)..(21): phosphorothioate-(deoxyribose)-g
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 557 - DNA, 26 bp, Artificial Sequence
  Description of Artificial Sequence: Synthetic oligonucleotide
  Description of Combined DNA/RNA Molecule: Synthetic oligonucleotide
  modified_base (1)..(1): phosphorothioate-(deoxyribose)-g
  modified_base (2)..(2): 2'-O-methyl-g
  modified_base (3)..(3): phosphorothioate-(deoxyribose)-g
  modified_base (4)..(4): 2'-O-methyl-naphthyl-dU
  modified_base (5)..(5): phosphorothioate-(deoxyribose)-naphthyl-dU
  modified_base (6)..(6): phosphorothioate-(deoxyribose)-a
  modified_base (7)..(7): phosphorothioate-(deoxyribose)-naphthyl-dU
  modified_base (8)..(8): 2'-O-methyl-g
  modified_base (9)..(9): 2'-O-methyl-morpholinoethyl-dU
  modified_base (10)..(10): phosphorothioate-(deoxyribose)-a
  modified_base (11)..(11): 2'-O-methyl-g
  modified_base (12)..(12): 2'-O-methyl-c
  misc_feature (12)..(13): C3 linker between nucleotides-C3 linker between nucleotides
  modified_base (13)..(13): 2'-O-methyl-g
  modified_base (14)..(14): 2'-O-methyl-morpholinoethyl-dU
  modified_base (15)..(15): 2'-O-methyl-g
  modified_base (16)..(16): phosphorothioate-(deoxyribose)-c
  modified_base (17)..(17): phosphorothioate-(deoxyribose)-g
  modified_base (18)..(18): 2'-O-methyl-naphthyl-dU
  modified_base (19)..(19): phosphorothioate-(deoxyribose)-a
  modified_base (20)..(20): phosphorothioate-(deoxyribose)-a
  modified_base (21)..(21): phosphorothioate-(deoxyribose)-g
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 558 - DNA, 26 bp, Artificial Sequence
  Description of Artificial Sequence: Synthetic oligonucleotide
  Description of Combined DNA/RNA Molecule: Synthetic oligonucleotide
  modified_base (1)..(1): phosphorothioate-(deoxyribose)-g
  modified_base (2)..(2): 2'-O-methyl-g
  modified_base (3)..(3): phosphorothioate-(deoxyribose)-g
  modified_base (4)..(4): 2'-O-methyl-pyridyl-dU
  modified_base (5)..(5): phosphorothioate-(deoxyribose)-naphthyl-dU
  modified_base (6)..(6): phosphorothioate-(deoxyribose)-a
  modified_base (7)..(7): phosphorothioate-(deoxyribose)-naphthyl-dU
  modified_base (8)..(8): 2'-O-methyl-g
  modified_base (9)..(9): 2'-O-methyl-morpholinoethyl-dU
  modified_base (10)..(10): phosphorothioate-(deoxyribose)-a
  modified_base (11)..(11): 2'-O-methyl-g
  modified_base (12)..(12): 2'-O-methyl-c
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (16)..(16): phosphorothioate-(deoxyribose)-c
  modified_base (17)..(17): phosphorothioate-(deoxyribose)-g
  modified_base (18)..(18): 2'-O-methyl-naphthyl-dU
  modified_base (19)..(19): phosphorothioate-(deoxyribose)-a
  modified_base (20)..(20): phosphorothioate-(deoxyribose)-a
  modified_base (21)..(21): phosphorothioate-(deoxyribose)-g
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 559 - DNA, 26 bp, Artificial Sequence
  Description of Artificial Sequence: Synthetic oligonucleotide
  Description of Combined DNA/RNA Molecule: Synthetic oligonucleotide
  modified_base (1)..(1): phosphorothioate-(deoxyribose)-g
  modified_base (2)..(2): 2'-O-methyl-g
  modified_base (3)..(3): phosphorothioate-(deoxyribose)-g
  modified_base (4)..(4): 2'-O-methyl-naphthyl-dU
  modified_base (5)..(5): phosphorothioate-(deoxyribose)-naphthyl-dU
  modified_base (6)..(6): phosphorothioate-(deoxyribose)-a
  modified_base (7)..(7): phosphorothioate-(deoxyribose)-naphthyl-dU
  modified_base (8)..(8): 2'-O-methyl-g
  modified_base (9)..(9): 2'-O-methyl-morpholinoethyl-dU
  modified_base (10)..(10): phosphorothioate-(deoxyribose)-a
  modified_base (11)..(11): 2'-O-methyl-g
  modified_base (12)..(12): 2'-O-methyl-c
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (16)..(16): phosphorothioate-(deoxyribose)-c
  modified_base (17)..(17): phosphorothioate-(deoxyribose)-g
  modified_base (18)..(18): 2'-O-methyl-pyridyl-dU
  modified_base (19)..(19): phosphorothioate-(deoxyribose)-a
  modified_base (20)..(20): phosphorothioate-(deoxyribose)-a
  modified_base (21)..(21): phosphorothioate-(deoxyribose)-g
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 560 - DNA, 26 bp, Artificial Sequence
  Description of Artificial Sequence: Synthetic oligonucleotide
  Description of Combined DNA/RNA Molecule: Synthetic oligonucleotide
  modified_base (1)..(1): phosphorothioate-(deoxyribose)-g
  modified_base (2)..(2): 2'-O-methyl-g
  modified_base (3)..(3): phosphorothioate-(deoxyribose)-g
  modified_base (4)..(4): 2'-O-methyl-pyridyl-dU
  modified_base (5)..(5): phosphorothioate-(deoxyribose)-naphthyl-dU
  modified_base (6)..(6): phosphorothioate-(deoxyribose)-a
  modified_base (7)..(7): phosphorothioate-(deoxyribose)-naphthyl-dU
  modified_base (8)..(8): 2'-O-methyl-g
  modified_base (9)..(9): 2'-O-methyl-morpholinoethyl-dU
  modified_base (10)..(10): phosphorothioate-(deoxyribose)-a
  modified_base (11)..(11): 2'-O-methyl-g
  modified_base (12)..(12): 2'-O-methyl-c
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (16)..(16): phosphorothioate-(deoxyribose)-c
  modified_base (17)..(17): phosphorothioate-(deoxyribose)-g
  modified_base (18)..(18): 2'-O-methyl-pyridyl-dU
  modified_base (19)..(19): phosphorothioate-(deoxyribose)-a
  modified_base (20)..(20): phosphorothioate-(deoxyribose)-a
  modified_base (21)..(21): phosphorothioate-(deoxyribose)-g
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 561 - DNA, 26 bp, Artificial Sequence
  Description of Artificial Sequence: Synthetic oligonucleotide
  Description of Combined DNA/RNA Molecule: Synthetic oligonucleotide
  modified_base (1)..(1): phosphorothioate-(deoxyribose)-g
  modified_base (2)..(2): 2'-O-methyl-g
  modified_base (3)..(3): phosphorothioate-(deoxyribose)-g
  modified_base (4)..(4): 2'-O-methyl-pyridyl-dU
  modified_base (5)..(5): phosphorothioate-(deoxyribose)-naphthyl-dU
  modified_base (6)..(6): phosphorothioate-(deoxyribose)-a
  modified_base (7)..(7): phosphorothioate-(deoxyribose)-naphthyl-dU
  modified_base (8)..(8): 2'-O-methyl-g
  modified_base (9)..(9): 2'-O-methyl-morpholinoethyl-dU
  modified_base (10)..(10): phosphorothioate-(deoxyribose)-a
  modified_base (11)..(11): 2'-O-methyl-g
  modified_base (12)..(12): 2'-O-methyl-c
  misc_feature (12)..(13): C3 linker between nucleotides-C3 linker between nucleotides
  modified_base (13)..(13): 2'-O-methyl-g
  modified_base (14)..(14): 2'-O-methyl-morpholinoethyl-dU
  modified_base (15)..(15): 2'-O-methyl-g
  modified_base (16)..(16): phosphorothioate-(deoxyribose)-c
  modified_base (17)..(17): phosphorothioate-(deoxyribose)-g
  modified_base (18)..(18): 2'-O-methyl-pyridyl-dU
  modified_base (19)..(19): phosphorothioate-(deoxyribose)-a
  modified_base (20)..(20): phosphorothioate-(deoxyribose)-a
  modified_base (21)..(21): phosphorothioate-(deoxyribose)-g
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 562 - DNA, 26 bp, Artificial Sequence
  Description of Artificial Sequence: Synthetic oligonucleotide
  Description of Combined DNA/RNA Molecule: Synthetic oligonucleotide
  modified_base (1)..(1): phosphorothioate-(deoxyribose)-g
  modified_base (2)..(2): 2'-O-methyl-g
  modified_base (3)..(3): phosphorothioate-(deoxyribose)-g
  modified_base (4)..(4): 2'-O-methyl-pyridyl-dU
  modified_base (5)..(5): phosphorothioate-(deoxyribose)-naphthyl-dU
  modified_base (6)..(6): phosphorothioate-(deoxyribose)-a
  modified_base (7)..(7): phosphorothioate-(deoxyribose)-naphthyl-dU
  modified_base (8)..(8): 2'-O-methyl-g
  modified_base (9)..(9): 2'-O-methyl-morpholinoethyl-dU
  modified_base (10)..(10): phosphorothioate-(deoxyribose)-a
  modified_base (11)..(11): 2'-O-methyl-g
  modified_base (12)..(12): 2'-O-methyl-c
  misc_feature (12)..(13): C3 linker between nucleotides-C3 linker between nucleotides
  modified_base (13)..(13): 2'-O-methyl-g
  modified_base (14)..(14): 2'-O-methyl-morpholinoethyl-dU
  modified_base (15)..(15): 2'-O-methyl-g
  modified_base (16)..(16): phosphorothioate-(deoxyribose)-c
  modified_base (17)..(17): phosphorothioate-(deoxyribose)-g
  modified_base (18)..(18): 2'-O-methyl-pyridyl-dU
  modified_base (19)..(19): phosphorothioate-(deoxyribose)-a
  modified_base (20)..(20): phosphorothioate-(deoxyribose)-a
  modified_base (21)..(21): phosphorothioate-(deoxyribose)-g
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-methylenedioxybenzyl-dU
ggguuauguagcgugcguaaggcggu

SEQ ID NO: 563 - DNA, 26 bp, Artificial Sequence
  Description of Artificial Sequence: Synthetic oligonucleotide
  Description of Combined DNA/RNA Molecule: Synthetic oligonucleotide
  modified_base (1)..(1): phosphorothioate-(deoxyribose)-g
  modified_base (2)..(2): 2'-O-methyl-g
  modified_base (3)..(3): phosphorothioate-(deoxyribose)-g
  modified_base (4)..(4): 2'-O-methyl-naphthyl-dU
  modified_base (5)..(5): phosphorothioate-(deoxyribose)-naphthyl-dU
  modified_base (6)..(6): phosphorothioate-(deoxyribose)-a
  modified_base (7)..(7): phosphorothioate-(deoxyribose)-naphthyl-dU
  modified_base (8)..(8): 2'-O-methyl-g
  modified_base (9)..(9): 2'-O-methyl-naphthyl-dU
  modified_base (10)..(10): phosphorothioate-(deoxyribose)-a
  modified_base (11)..(11): 2'-O-methyl-g
  modified_base (12)..(12): 2'-O-methyl-c
  misc_feature (12)..(13): C3 linker between nucleotides-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (16)..(16): phosphorothioate-(deoxyribose)-c
  modified_base (17)..(17): phosphorothioate-(deoxyribose)-g
  modified_base (18)..(18): 2'-O-methyl-naphthyl-dU
  modified_base (19)..(19): phosphorothioate-(deoxyribose)-a
  modified_base (20)..(20): phosphorothioate-(deoxyribose)-a
  modified_base (21)..(21): phosphorothioate-(deoxyribose)-g
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-methylenedioxybenzyl-dU
ggguuauguagcgugcguaaggcggu

SEQ ID NO: 564 - DNA, 26 bp, Artificial Sequence
  Description of Artificial Sequence: Synthetic oligonucleotide
  Description of Combined DNA/RNA Molecule: Synthetic oligonucleotide
  modified_base (1)..(1): phosphorothioate-(deoxyribose)-g
  modified_base (2)..(2): 2'-O-methyl-g
  modified_base (3)..(3): phosphorothioate-(deoxyribose)-g
  modified_base (4)..(4): 2'-O-methyl-naphthyl-dU
  modified_base (5)..(5): phosphorothioate-(deoxyribose)-naphthyl-dU
  modified_base (6)..(6): phosphorothioate-(deoxyribose)-a
  modified_base (7)..(7): phosphorothioate-(deoxyribose)-naphthyl-dU
  modified_base (8)..(8): 2'-O-methyl-g
  modified_base (9)..(9): 2'-O-methyl-morpholinoethyl-dU
  modified_base (10)..(10): phosphorothioate-(deoxyribose)-a
  modified_base (11)..(11): 2'-O-methyl-g
  modified_base (12)..(12): 2'-O-methyl-c
  misc_feature (12)..(13): phosphorothioate-C3-phosphorothioate-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (16)..(16): phosphorothioate-(deoxyribose)-c
  modified_base (17)..(17): phosphorothioate-(deoxyribose)-g
  modified_base (18)..(18): 2'-O-methyl-naphthyl-dU
  modified_base (19)..(19): phosphorothioate-(deoxyribose)-a
  modified_base (20)..(20): phosphorothioate-(deoxyribose)-a
  modified_base (21)..(21): phosphorothioate-(deoxyribose)-g
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 565 - DNA, 26 bp, Artificial Sequence
  Description of Artificial Sequence: Synthetic oligonucleotide
  Description of Combined DNA/RNA Molecule: Synthetic oligonucleotide
  modified_base (1)..(1): phosphorothioate-(deoxyribose)-g
  modified_base (2)..(2): 2'-O-methyl-g
  modified_base (3)..(3): phosphorothioate-(deoxyribose)-g
  modified_base (4)..(4): 2'-O-methyl-naphthyl-dU
  modified_base (5)..(5): phosphorothioate-(deoxyribose)-naphthyl-dU
  modified_base (6)..(6): phosphorothioate-(deoxyribose)-a
  modified_base (7)..(7): phosphorothioate-(deoxyribose)-naphthyl-dU
  modified_base (8)..(8): 2'-O-methyl-g
  modified_base (9)..(9): 2'-O-methyl-morpholinoethyl-dU
  modified_base (10)..(10): phosphorothioate-(deoxyribose)-a
  modified_base (11)..(11): 2'-O-methyl-g
  modified_base (12)..(12): 2'-O-methyl-c
  misc_feature (12)..(13): phosphorothioate-C3-phosphorothioate-C3 linker between nucleotides
  modified_base (13)..(13): 2'-O-methyl-g
  modified_base (14)..(14): 2'-O-methyl-morpholinoethyl-dU
  modified_base (15)..(15): 2'-O-methyl-g
  modified_base (16)..(16): phosphorothioate-(deoxyribose)-c
  modified_base (17)..(17): phosphorothioate-(deoxyribose)-g
  modified_base (18)..(18): 2'-O-methyl-naphthyl-dU
  modified_base (19)..(19): phosphorothioate-(deoxyribose)-a
  modified_base (20)..(20): phosphorothioate-(deoxyribose)-a
  modified_base (21)..(21): phosphorothioate-(deoxyribose)-g
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 566 - DNA, 26 bp, Artificial Sequence
  Description of Artificial Sequence: Synthetic oligonucleotide
  Description of Combined DNA/RNA Molecule: Synthetic oligonucleotide
  modified_base (1)..(1): phosphorothioate-(deoxyribose)-g
  modified_base (2)..(2): 2'-O-methyl-g
  modified_base (3)..(3): phosphorothioate-(deoxyribose)-g
  modified_base (4)..(4): 2'-O-methyl-pyridyl-dU
  modified_base (5)..(5): phosphorothioate-(deoxyribose)-naphthyl-dU
  modified_base (6)..(6): phosphorothioate-(deoxyribose)-a
  modified_base (7)..(7): phosphorothioate-(deoxyribose)-naphthyl-dU
  modified_base (8)..(8): 2'-O-methyl-g
  modified_base (9)..(9): 2'-O-methyl-morpholinoethyl-dU
  modified_base (10)..(10): phosphorothioate-(deoxyribose)-a
  modified_base (11)..(11): 2'-O-methyl-g
  modified_base (12)..(12): 2'-O-methyl-c
  misc_feature (12)..(13): phosphorothioate-C3-phosphorothioate-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (16)..(16): phosphorothioate-(deoxyribose)-c
  modified_base (17)..(17): phosphorothioate-(deoxyribose)-g
  modified_base (18)..(18): 2'-O-methyl-naphthyl-dU
  modified_base (19)..(19): phosphorothioate-(deoxyribose)-a
  modified_base (20)..(20): phosphorothioate-(deoxyribose)-a
  modified_base (21)..(21): phosphorothioate-(deoxyribose)-g
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 567 - DNA, 26 bp, Artificial Sequence
  Description of Artificial Sequence: Synthetic oligonucleotide
  Description of Combined DNA/RNA Molecule: Synthetic oligonucleotide
  modified_base (1)..(1): phosphorothioate-(deoxyribose)-g
  modified_base (2)..(2): 2'-O-methyl-g
  modified_base (3)..(3): phosphorothioate-(deoxyribose)-g
  modified_base (4)..(4): 2'-O-methyl-naphthyl-dU
  modified_base (5)..(5): phosphorothioate-(deoxyribose)-naphthyl-dU
  modified_base (6)..(6): phosphorothioate-(deoxyribose)-a
  modified_base (7)..(7): phosphorothioate-(deoxyribose)-naphthyl-dU
  modified_base (8)..(8): 2'-O-methyl-g
  modified_base (9)..(9): 2'-O-methyl-morpholinoethyl-dU
  modified_base (10)..(10): phosphorothioate-(deoxyribose)-a
  modified_base (11)..(11): 2'-O-methyl-g
  modified_base (12)..(12): 2'-O-methyl-c
  misc_feature (12)..(13): phosphorothioate-C3-phosphorothioate-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (16)..(16): phosphorothioate-(deoxyribose)-c
  modified_base (17)..(17): phosphorothioate-(deoxyribose)-g
  modified_base (18)..(18): 2'-O-methyl-pyridyl-dU
  modified_base (19)..(19): phosphorothioate-(deoxyribose)-a
  modified_base (20)..(20): phosphorothioate-(deoxyribose)-a
  modified_base (21)..(21): phosphorothioate-(deoxyribose)-g
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 568 - DNA, 26 bp, Artificial Sequence
  Description of Artificial Sequence: Synthetic oligonucleotide
  Description of Combined DNA/RNA Molecule: Synthetic oligonucleotide
  modified_base (1)..(1): phosphorothioate-(deoxyribose)-g
  modified_base (2)..(2): 2'-O-methyl-g
  modified_base (3)..(3): phosphorothioate-(deoxyribose)-g
  modified_base (4)..(4): 2'-O-methyl-pyridyl-dU
  modified_base (5)..(5): phosphorothioate-(deoxyribose)-naphthyl-dU
  modified_base (6)..(6): phosphorothioate-(deoxyribose)-a
  modified_base (7)..(7): phosphorothioate-(deoxyribose)-naphthyl-dU
  modified_base (8)..(8): 2'-O-methyl-g
  modified_base (9)..(9): 2'-O-methyl-morpholinoethyl-dU
  modified_base (10)..(10): phosphorothioate-(deoxyribose)-a
  modified_base (11)..(11): 2'-O-methyl-g
  modified_base (12)..(12): 2'-O-methyl-c
  misc_feature (12)..(13): phosphorothioate-C3-phosphorothioate-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (16)..(16): phosphorothioate-(deoxyribose)-c
  modified_base (17)..(17): phosphorothioate-(deoxyribose)-g
  modified_base (18)..(18): 2'-O-methyl-pyridyl-dU
  modified_base (19)..(19): phosphorothioate-(deoxyribose)-a
  modified_base (20)..(20): phosphorothioate-(deoxyribose)-a
  modified_base (21)..(21): phosphorothioate-(deoxyribose)-g
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 569 - DNA, 26 bp, Artificial Sequence
  Description of Artificial Sequence: Synthetic oligonucleotide
  Description of Combined DNA/RNA Molecule: Synthetic oligonucleotide
  modified_base (1)..(1): phosphorothioate-(deoxyribose)-g
  modified_base (2)..(2): 2'-O-methyl-g
  modified_base (3)..(3): phosphorothioate-(deoxyribose)-g
  modified_base (4)..(4): 2'-O-methyl-pyridyl-dU
  modified_base (5)..(5): phosphorothioate-(deoxyribose)-naphthyl-dU
  modified_base (6)..(6): phosphorothioate-(deoxyribose)-a
  modified_base (7)..(7): phosphorothioate-(deoxyribose)-naphthyl-dU
  modified_base (8)..(8): 2'-O-methyl-g
  modified_base (9)..(9): 2'-O-methyl-morpholinoethyl-dU
  modified_base (10)..(10): phosphorothioate-(deoxyribose)-a
  modified_base (11)..(11): 2'-O-methyl-g
  modified_base (12)..(12): 2'-O-methyl-c
  misc_feature (12)..(13): phosphorothioate-C3-phosphorothioate-C3 linker between nucleotides
  modified_base (13)..(13): 2'-O-methyl-g
  modified_base (14)..(14): 2'-O-methyl-morpholinoethyl-dU
  modified_base (15)..(15): 2'-O-methyl-g
  modified_base (16)..(16): phosphorothioate-(deoxyribose)-c
  modified_base (17)..(17): phosphorothioate-(deoxyribose)-g
  modified_base (18)..(18): 2'-O-methyl-pyridyl-dU
  modified_base (19)..(19): phosphorothioate-(deoxyribose)-a
  modified_base (20)..(20): phosphorothioate-(deoxyribose)-a
  modified_base (21)..(21): phosphorothioate-(deoxyribose)-g
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-naphthyl-dU
ggguuauguagcgugcguaaggcggu

SEQ ID NO: 570 - DNA, 26 bp, Artificial Sequence
  Description of Artificial Sequence: Synthetic oligonucleotide
  Description of Combined DNA/RNA Molecule: Synthetic oligonucleotide
  modified_base (1)..(1): phosphorothioate-(deoxyribose)-g
  modified_base (2)..(2): 2'-O-methyl-g
  modified_base (3)..(3): phosphorothioate-(deoxyribose)-g
  modified_base (4)..(4): 2'-O-methyl-pyridyl-dU
  modified_base (5)..(5): phosphorothioate-(deoxyribose)-naphthyl-dU
  modified_base (6)..(6): phosphorothioate-(deoxyribose)-a
  modified_base (7)..(7): phosphorothioate-(deoxyribose)-naphthyl-dU
  modified_base (8)..(8): 2'-O-methyl-g
  modified_base (9)..(9): 2'-O-methyl-morpholinoethyl-dU
  modified_base (10)..(10): phosphorothioate-(deoxyribose)-a
  modified_base (11)..(11): 2'-O-methyl-g
  modified_base (12)..(12): 2'-O-methyl-c
  misc_feature (12)..(13): phosphorothioate-C3-phosphorothioate-C3 linker between nucleotides
  modified_base (13)..(13): 2'-O-methyl-g
  modified_base (14)..(14): 2'-O-methyl-morpholinoethyl-dU
  modified_base (15)..(15): 2'-O-methyl-g
  modified_base (16)..(16): phosphorothioate-(deoxyribose)-c
  modified_base (17)..(17): phosphorothioate-(deoxyribose)-g
  modified_base (18)..(18): 2'-O-methyl-pyridyl-dU
  modified_base (19)..(19): phosphorothioate-(deoxyribose)-a
  modified_base (20)..(20): phosphorothioate-(deoxyribose)-a
  modified_base (21)..(21): phosphorothioate-(deoxyribose)-g
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-methylenedioxybenzyl-dU
ggguuauguagcgugcguaaggcggu

SEQ ID NO: 571 - DNA, 26 bp, Artificial Sequence
  Description of Artificial Sequence: Synthetic oligonucleotide
  Description of Combined DNA/RNA Molecule: Synthetic oligonucleotide
  modified_base (1)..(1): phosphorothioate-(deoxyribose)-g
  modified_base (2)..(2): 2'-O-methyl-g
  modified_base (3)..(3): phosphorothioate-(deoxyribose)-g
  modified_base (4)..(4): 2'-O-methyl-naphthyl-dU
  modified_base (5)..(5): phosphorothioate-(deoxyribose)-naphthyl-dU
  modified_base (6)..(6): phosphorothioate-(deoxyribose)-a
  modified_base (7)..(7): phosphorothioate-(deoxyribose)-naphthyl-dU
  modified_base (8)..(8): 2'-O-methyl-g
  modified_base (9)..(9): 2'-O-methyl-naphthyl-dU
  modified_base (10)..(10): phosphorothioate-(deoxyribose)-a
  modified_base (11)..(11): 2'-O-methyl-g
  modified_base (12)..(12): 2'-O-methyl-c
  misc_feature (12)..(13): phosphorothioate-C3-phosphorothioate-C3 linker between nucleotides
  modified_base (13)..(13): 2'-O-methyl-g
  modified_base (14)..(14): 2'-O-methyl-u
  modified_base (15)..(15): 2'-O-methyl-g
  modified_base (16)..(16): phosphorothioate-(deoxyribose)-c
  modified_base (17)..(17): phosphorothioate-(deoxyribose)-g
  modified_base (18)..(18): 2'-O-methyl-naphthyl-dU
  modified_base (19)..(19): phosphorothioate-(deoxyribose)-a
  modified_base (20)..(20): phosphorothioate-(deoxyribose)-a
  modified_base (21)..(21): phosphorothioate-(deoxyribose)-g
  modified_base (22)..(22): 2'-O-methyl-g
  modified_base (23)..(23): phosphorothioate-(deoxyribose)-c
  modified_base (24)..(24): 2'-O-methyl-g
  modified_base (25)..(25): 2'-O-methyl-g
  modified_base (26)..(26): 2'-O-methyl-methylenedioxybenzyl-dU
ggguuauguagcgugcguaaggcggu

SEQ ID NO: 572 - DNA, 30 bp, Artificial Sequence
  Description of Artificial Sequence: Synthetic oligonucleotide
ggggttatgtagcgagtgcgtaaggcggtg

SEQ ID NO: 573-598 - skipped (26 entries)

SEQ ID NO: 599 - DNA, 40 bp, Artificial Sequence
  Description of Artificial Sequence: Synthetic oligonucleotide
  Description of Combined DNA/RNA Molecule: Synthetic oligonucleotide
  modified_base (2)..(2): Bn-dU
  modified_base (5)..(7): Bn-dU
  modified_base (11)..(11): Bn-dU
  modified_base (18)..(20): Bn-dU
  modified_base (24)..(24): Bn-dU
  modified_base (28)..(28): Bn-dU
  modified_base (35)..(35): Bn-dU
cugguuuggcucgcggauuuacauaggugaaagcuggacc

SEQ ID NO: 600 - DNA, 36 bp, Artificial Sequence
  Description of Artificial Sequence: Synthetic oligonucleotide
  Description of Combined DNA/RNA Molecule: Synthetic oligonucleotide
  modified_base (3)..(5): Bn-dU
  modified_base (8)..(8): Bn-dU
  modified_base (10)..(11): Bn-dU
  modified_base (15)..(15): Bn-dU
  modified_base (19)..(21): Bn-dU
  modified_base (26)..(26): Bn-dU
  modified_base (33)..(33): Bn-dU
gguuugguguucgauggcuuucggauacagagucac

SEQ ID NO: 601 - DNA, 41 bp, Artificial Sequence
  Description of Artificial Sequence: Synthetic oligonucleotide
  Description of Combined DNA/RNA Molecule: Synthetic oligonucleotide
  modified_base (1)..(1): Bn-dU
  modified_base (6)..(6): Bn-dU
  modified_base (9)..(9): Bn-dU
  modified_base (11)..(12): Bn-dU
  modified_base (16)..(17): Bn-dU
  modified_base (20)..(20): Bn-dU
  modified_base (22)..(22): Bn-dU
  modified_base (25)..(26): Bn-dU
  modified_base (31)..(33): Bn-dU
  modified_base (41)..(41): Bn-dU
uacccugguguuggguuaaugugguugcgguuuggcaacau

SEQ ID NO: 602 - DNA, 40 bp, Artificial Sequence
  Description of Artificial Sequence: Synthetic oligonucleotide
  Description of Combined DNA/RNA Molecule: Synthetic oligonucleotide
  modified_base (3)..(3): Bn-dU
  modified_base (8)..(8): Bn-dU
  modified_base (10)..(11): Bn-dU
  modified_base (16)..(17): Bn-dU
  modified_base (21)..(22): Bn-dU
  modified_base (25)..(25): Bn-dU
  modified_base (27)..(27): Bn-dU
  modified_base (30)..(31): Bn-dU
  modified_base (36)..(38): Bn-dU
aauggaaucuucagcuuggguuaaugugguugggguuugg

SEQ ID NO: 603 - DNA, 40 bp, Artificial Sequence
  Description of Artificial Sequence: Synthetic oligonucleotide
  Description of Combined DNA/RNA Molecule: Synthetic oligonucleotide
  modified_base (6)..(7): Bn-dU
  modified_base (11)..(12): Bn-dU
  modified_base (15)..(15): Bn-dU
  modified_base (17)..(17): Bn-dU
  modified_base (20)..(21): Bn-dU
  modified_base (26)..(28): Bn-dU
  modified_base (33)..(33): Bn-dU
  modified_base (36)..(36): Bn-dU
accgauuggguuaaugugguugcgguuuggcaugguacgc

SEQ ID NO: 604 - DNA, 39 bp, Artificial Sequence
  Description of Artificial Sequence: Synthetic oligonucleotide
  Description of Combined DNA/RNA Molecule: Synthetic oligonucleotide
  modified_base (1)..(1): Bn-dU
  modified_base (4)..(4): Bn-dU
  modified_base (8)..(9): Bn-dU
  modified_base (13)..(14): Bn-dU
  modified_base (17)..(17): Bn-dU
  modified_base (19)..(19): Bn-dU
  modified_base (22)..(23): Bn-dU
  modified_base (25)..(25): Bn-dU
  modified_base (29)..(31): Bn-dU
ucaugaguuggguuaaugugguugucgguuugggaacgc

SEQ ID NO: 605 - DNA, 40 bp, Artificial Sequence
  Description of Artificial Sequence: Synthetic oligonucleotide
  Description of Combined DNA/RNA Molecule: Synthetic oligonucleotide
  modified_base (3)..(3): Bn-dU
  modified_base (7)..(8): Bn-dU
  modified_base (11)..(11): Bn-dU
  modified_base (13)..(13): Bn-dU
  modified_base (16)..(17): Bn-dU
  modified_base (22)..(24): Bn-dU
  modified_base (31)..(31): Bn-dU
  modified_base (34)..(34): Bn-dU
  modified_base (37)..(37): Bn-dU
  modified_base (40)..(40): Bn-dU
gcuggguuaaugugguugcgguuugggaggucaucgugau

SEQ ID NO: 606 - DNA, 40 bp, Artificial Sequence
  Description of Artificial Sequence: Synthetic oligonucleotide
  Description of Combined DNA/RNA Molecule: Synthetic oligonucleotide
  modified_base (3)..(3): Bn-dU
  modified_base (5)..(5): Bn-dU
  modified_base (9)..(10): Bn-dU
  modified_base (13)..(13): Bn-dU
  modified_base (15)..(15): Bn-dU
  modified_base (18)..(19): Bn-dU
  modified_base (24)..(26): Bn-dU
  modified_base (33)..(33): Bn-dU
  modified_base (36)..(36): Bn-dU
  modified_base (39)..(39): Bn-dU
gguauggguuaaugugguugcgguuugggcgcucgugauc

SEQ ID NO: 607 - DNA, 39 bp, Artificial Sequence
  Description of Artificial Sequence: Synthetic oligonucleotide
  Description of Combined DNA/RNA Molecule: Synthetic oligonucleotide
  modified_base (1)..(1): Bn-dU
  modified_base (8)..(8): Bn-dU
  modified_base (12)..(13): Bn-dU
  modified_base (16)..(16): Bn-dU
  modified_base (18)..(18): Bn-dU
  modified_base (21)..(22): Bn-dU
  modified_base (27)..(29): Bn-dU
  modified_base (35)..(35): Bn-dU
  modified_base (39)..(39): Bn-dU
ucggcccuggguuaaugugguugggguuuggcaguggcu

SEQ ID NO: 608 - DNA, 35 bp, Artificial Sequence
  Description of Artificial Sequence: Synthetic oligonucleotide
  Description of Combined DNA/RNA Molecule: Synthetic oligonucleotide
  modified_base (1)..(1): Bn-dU
  modified_base (6)..(6): Bn-dU
  modified_base (9)..(9): Bn-dU
  modified_base (11)..(12): Bn-dU
  modified_base (16)..(17): Bn-dU
  modified_base (20)..(20): Bn-dU
  modified_base (22)..(22): Bn-dU
  modified_base (25)..(26): Bn-dU
  modified_base (31)..(33): Bn-dU
uacccugauguuggguuaaugugguugggguuugg

SEQ ID NO: 609 - DNA, 46 bp, Artificial Sequence
  Description of Artificial Sequence: Synthetic oligonucleotide
  Description of Combined DNA/RNA Molecule: Synthetic oligonucleotide
  modified_base (3)..(3): Bn-dU
  modified_base (10)..(10): Bn-dU
  modified_base (12)..(13): Bn-dU
  modified_base (19)..(20): Bn-dU
  modified_base (23)..(25): Bn-dU
  modified_base (29)..(29): Bn-dU
  modified_base (31)..(31): Bn-dU
  modified_base (34)..(35): Bn-dU
  modified_base (41)..(43): Bn-dU
aauaggaagucuucagcguugguuuaagugugguuagggguuuggc

SEQ ID NO: 610 - DNA, 40 bp, Artificial Sequence
  Description of Artificial Sequence: Synthetic oligonucleotide
  Description of Combined DNA/RNA Molecule: Synthetic oligonucleotide
  modified_base (1)..(1): Bn-dU
  modified_base (7)..(7): Bn-dU
  modified_base (9)..(9): Bn-dU
  modified_base (12)..(13): Bn-dU
  modified_base (26)..(28): Bn-dU
  modified_base (31)..(31): Bn-dU
  modified_base (33)..(33): Bn-dU
  modified_base (35)..(35): Bn-dU
uaaggaugugguuggcacgggcagguuuggucuguagcca

SEQ ID NO: 611 - DNA, 40 bp, Artificial Sequence
  Description of Artificial Sequence: Synthetic oligonucleotide
  Description of Combined DNA/RNA Molecule: Synthetic oligonucleotide
  modified_base (3)..(4): Bn-dU
  modified_base (11)..(11): Bn-dU
  modified_base (19)..(21): Bn-dU
  modified_base (27)..(27): Bn-dU
  modified_base (29)..(29): Bn-dU
  modified_base (32)..(32): Bn-dU
  modified_base (35)..(35): Bn-dU
  modified_base (37)..(38): Bn-dU
gcuugggcgguagcgggguuuggggaugugcugcucuuca

SEQ ID NO: 612 - DNA, 39 bp, Artificial Sequence
  Description of Artificial Sequence: Synthetic oligonucleotide
  Description of Combined DNA/RNA Molecule: Synthetic oligonucleotide
  modified_base (1)..(1): Bn-dU
  modified_base (5)..(5): Bn-dU
  modified_base (7)..(8): Bn-dU
  modified_base (19)..(19): Bn-dU
  modified_base (24)..(26): Bn-dU
  modified_base (29)..(29): Bn-dU
  modified_base (31)..(31): Bn-dU
uaagucuuggcaggaggguaagguuugguauggagcgaa

SEQ ID NO: 613 - DNA, 40 bp, Artificial Sequence
  Description of Artificial Sequence: Synthetic oligonucleotide
  Description of Combined DNA/RNA Molecule: Synthetic oligonucleotide
  modified_base (1)..(1): Bn-dU
  modified_base (7)..(8): Bn-dU
  modified_base (27)..(29): Bn-dU
  modified_base (32)..(32): Bn-dU
  modified_base (34)..(34): Bn-dU
  modified_base (36)..(37): Bn-dU
uaagaauuggagggggagcgaggagguuugguauguucgg

SEQ ID NO: 614 - DNA, 40 bp, Artificial Sequence
  Description of Artificial Sequence: Synthetic oligonucleotide
  Description of Combined DNA/RNA Molecule: Synthetic oligonucleotide
  modified_base (1)..(2): Bn-dU
  modified_base (8)..(9): Bn-dU
  modified_base (22)..(22): Bn-dU
  modified_base (28)..(30): Bn-dU
  modified_base (33)..(33): Bn-dU
  modified_base (37)..(37): Bn-dU
uuagcaauugggccaggcggguggagguuuggugcgucgg

SEQ ID NO: 615 - DNA, 40 bp, Artificial Sequence
  Description of Artificial Sequence: Synthetic oligonucleotide
  Description of Combined DNA/RNA Molecule: Synthetic oligonucleotide
  modified_base (2)..(2): Bn-dU
  modified_base (6)..(6): Bn-dU
  modified_base (12)..(13): Bn-dU
  modified_base (22)..(22): Bn-dU
  modified_base (24)..(24): Bn-dU
  modified_base (28)..(30): Bn-dU
  modified_base (33)..(33): Bn-dU
  modified_base (35)..(35): Bn-dU
  modified_base (37)..(37): Bn-dU
gugcguaagaguuggcacgggucuagguuugguauguagc

SEQ ID NO: 616 - DNA, 40 bp, Artificial Sequence
  Description of Artificial Sequence: Synthetic oligonucleotide
  Description of Combined DNA/RNA Molecule: Synthetic oligonucleotide
  modified_base (2)..(2): Bn-dU
  modified_base (4)..(4): Bn-dU
  modified_base (6)..(6): Bn-dU
  modified_base (8)..(9): Bn-dU
  modified_base (11)..(11): Bn-dU
  modified_base (13)..(13): Bn-dU
  modified_base (15)..(15): Bn-dU
  modified_base (18)..(18): Bn-dU
  modified_base (21)..(21): Bn-dU
  modified_base (26)..(26): Bn-dU
  modified_base (28)..(28): Bn-dU
  modified_base (31)..(33): Bn-dU
  modified_base (37)..(40): Bn-dU
cuguauguuauauguccuggugcggucugguuuggguuuu

SEQ ID NO: 617 - DNA, 41 bp, Artificial Sequence
  Description of Artificial Sequence: Synthetic oligonucleotide
  Description of Combined DNA/RNA Molecule: Synthetic oligonucleotide
  modified_base (3)..(3): Bn-dU
  modified_base (7)..(7): Bn-dU
  modified_base (10)..(10): Bn-dU
  modified_base (15)..(15): Bn-dU
  modified_base (18)..(18): Bn-dU
  modified_base (23)..(26): Bn-dU
  modified_base (37)..(39): Bn-dU
ccuccgugcugcgaugcuaaaauuuugaaaaggcgguuugg

SEQ ID NO: 618 - DNA, 40 bp, Artificial Sequence
  Description of Artificial Sequence: Synthetic oligonucleotide
  Description of Combined DNA/RNA Molecule: Synthetic oligonucleotide
  modified_base (1)..(2): Bn-dU
  modified_base (4)..(4): Bn-dU
  modified_base (8)..(8): Bn-dU
  modified_base (10)..(10): Bn-dU
  modified_base (13)..(14): Bn-dU
  modified_base (29)..(31): Bn-dU
  modified_base (34)..(34): Bn-dU
  modified_base (37)..(37): Bn-dU
uuaugggugucguuggggaacagggcgguuuggugcugca

SEQ ID NO: 619 - DNA, 39 bp, Artificial Sequence
  Description of Artificial Sequence: Synthetic oligonucleotide
  Description of Combined DNA/RNA Molecule: Synthetic oligonucleotide
  modified_base (8)..(8): Nap-dU
  modified_base (10)..(11): Nap-dU
  modified_base (13)..(13): Nap-dU
  modified_base (15)..(15): Nap-dU
  modified_base (23)..(23): Nap-dU
  modified_base (26)..(26): Nap-dU
  modified_base (34)..(34): Nap-dU
  modified_base (36)..(36): Nap-dU
cgggaacuguuauguagcgaagucguaaggcgguguagc

SEQ ID NO: 620 - DNA, 40 bp, Artificial Sequence
  Description of Artificial Sequence: Synthetic oligonucleotide
  Description of Combined DNA/RNA Molecule: Synthetic oligonucleotide
  modified_base (1)..(1): Nap-dU
  modified_base (10)..(11): Nap-dU
  modified_base (13)..(13): Nap-dU
  modified_base (15)..(15): Nap-dU
  modified_base (27)..(27): Nap-dU
  modified_base (35)..(35): Nap-dU
ugcgagggguuauguagacgggagcguaaggcggucggag

SEQ ID NO: 621 - DNA, 40 bp, Artificial Sequence
  Description of Artificial Sequence: Synthetic oligonucleotide
  Description of Combined DNA/RNA Molecule: Synthetic oligonucleotide
  modified_base (4)..(4): Nap-dU
  modified_base (12)..(12): Nap-dU
  modified_base (15)..(15): Nap-dU
  modified_base (17)..(17): Nap-dU
  modified_base (24)..(24): Nap-dU
  modified_base (30)..(31): Nap-dU
  modified_base (33)..(33): Nap-dU
  modified_base (35)..(35): Nap-dU
ccguaagccgguagugugcgcccucacgauuauguaggac

SEQ ID NO: 622 - DNA, 39 bp, Artificial Sequence
  Description of Artificial Sequence: Synthetic oligonucleotide
  Description of Combined DNA/RNA Molecule: Synthetic oligonucleotide
  modified_base (1)..(1): Nap-dU
  modified_base (4)..(4): Nap-dU
  modified_base (12)..(12): Nap-dU
  modified_base (17)..(17): Nap-dU
  modified_base (21)..(22): Nap-dU
  modified_base (24)..(24): Nap-dU
  modified_base (26)..(26): Nap-dU
ucguaaggcgauccccugaauuauguagggaggagcggc

SEQ ID NO: 623 - DNA, 40 bp, Artificial Sequence
  Description of Artificial Sequence: Synthetic oligonucleotide
  Description of Combined DNA/RNA Molecule: Synthetic oligonucleotide
  modified_base (3)..(3): Nap-dU
  modified_base (11)..(11): Nap-dU
  modified_base (21)..(22): Nap-dU
  modified_base (24)..(24): Nap-dU
  modified_base (26)..(26): Nap-dU
  modified_base (35)..(35): Nap-dU
  modified_base (37)..(37): Nap-dU
  modified_base (40)..(40): Nap-dU
aguaaggcgguccaaagggauuauguagcgaaggucuacu

SEQ ID NO: 624 - DNA, 38 bp, Artificial Sequence
  Description of Artificial Sequence: Synthetic oligonucleotide
  Description of Combined DNA/RNA Molecule: Synthetic oligonucleotide
  modified_base (4)..(4): Nap-dU
  modified_base (12)..(12): Nap-dU
  modified_base (15)..(15): Nap-dU
  modified_base (17)..(17): Nap-dU
  modified_base (19)..(19): Nap-dU
  modified_base (29)..(29): Nap-dU
  modified_base (38)..(38): Nap-dU
acguaaggcgguacuauguagcgaggaauaaccagccu

SEQ ID NO: 625 - DNA, 41 bp, Artificial Sequence
  Description of Artificial Sequence: Synthetic oligonucleotide
  Description of Combined DNA/RNA Molecule: Synthetic oligonucleotide
  modified_base (5)..(5): Nap-dU
  modified_base (13)..(13): Nap-dU
  modified_base (19)..(19): Nap-dU
  modified_base (24)..(25): Nap-dU
  modified_base (27)..(27): Nap-dU
  modified_base (29)..(29): Nap-dU
  modified_base (35)..(35): Nap-dU
  modified_base (37)..(37): Nap-dU
cgaguaaggcggugaacguaggguuauguaacgcucucaac

SEQ ID NO: 626-699 - skipped (74 entries)

SEQ ID NO: 700 - DNA, 66 bp, Artificial Sequence
  Description of Artificial Sequence: Synthetic oligonucleotide
  Description of Combined DNA/RNA Molecule: Synthetic oligonucleotide
  modified_base (7)..(9): Independently selected from U, T or a modified pyrimidine
  modified_base (12)..(12): Independently selected from U, T or a modified pyrimidine
  modified_base (13)..(62): Independently selected from a linker, any modified nucleotide or any unmodified nucleotide
  misc_feature (13)..(62): This region may encompass 1-50, 1-40, 1-30, 1-20, 1-15, 1-10 or 1-5 nucleotides, wherein some positions may be absent or this region is absent in its entirety
  modified_base (64)..(64): Independently selected from U, T or a modified pyrimidine
  See specification as filed for detailed description of substitutions and preferred embodiments
ggcaggnnnggnnnnnnnnnnnnnnnnnnnnnnnnnnnnnnnnnnnnnnnnnnnnnnnnnnngngg

SEQ ID NO: 701 - DNA, 46 bp, Artificial Sequence
  Description of Artificial Sequence: Synthetic oligonucleotide
  Description of Combined DNA/RNA Molecule: Synthetic oligonucleotide
  modified_base (4)..(5): Independently selected from any modified pyrimidine
  modified_base (7)..(7): Independently selected from any modified pyrimidine
  modified_base (9)..(9): Independently selected from any modified pyrimidine
  modified_base (13)..(32): Independently selected from a linker, any modified nucleotide or any unmodified nucleotide
  misc_feature (13)..(32): This region may encompass 1-20, 1-15, 1-10 or 1-5 nucleotides, wherein some positions may be absent or this region is absent in its entirety
  modified_base (34)..(34): U, T or a modified pyrimidine
  modified_base (38)..(38): Independently selected from any modified pyrimidine
  modified_base (46)..(46): Independently selected from any modified pyrimidine
  See specification as filed for detailed description of substitutions and preferred embodiments
gggnnangnagcnnnnnnnnnnnnnnnnnnnngngcgnaaggcggn

SEQ ID NO: 702 - DNA, 111 bp, Artificial Sequence
  Description of Artificial Sequence: Synthetic oligonucleotide
  Description of Combined DNA/RNA Molecule: Synthetic oligonucleotide
  modified_base (3)..(5): Independently selected from U, T or a modified pyrimidine
  modified_base (8)..(57): Independently selected from a linker, any modified nucleotide or any unmodified nucleotide
  misc_feature (8)..(57): This region may encompass 1-50, 1-40, 1-30, 1-20, 1-15, 1-10 or 1-5 nucleotides, wherein some positions may be absent or this region is absent in its entirety
  modified_base (60)..(109): Independently selected from a linker, any modified nucleotide or any unmodified nucleotide
  misc_feature (60)..(109): This region may encompass 1-50, 1-40, 1-30, 1-20, 1-15, 1-10 or 1-5 nucleotides, wherein some positions may be absent or this region is absent in its entirety
  See specification as filed for detailed description of substitutions and preferred embodiments
ggnnnggnnnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnngg

SEQ ID NO: 703 - DNA, 111 bp, Artificial Sequence
  Description of Artificial Sequence: Synthetic oligonucleotide
  Description of Combined DNA/RNA Molecule: Synthetic oligonucleotide
  modified_base (3)..(52): Independently selected from a linker, any modified nucleotide or any unmodified nucleotide
  misc_feature (3)..(52): This region may encompass 1-50, 1-40, 1-30, 1-20, 1-15, 1-10 or 1-5 nucleotides, wherein some positions may be absent or this region is absent in its entirety
  modified_base (55)..(57): Independently selected from U, T or a modified pyrimidine
  modified_base (60)..(109): Independently selected from a linker, any modified nucleotide or any unmodified nucleotide
  misc_feature (60)..(109): This region may encompass 1-50, 1-40, 1-30, 1-20, 1-15, 1-10 or 1-5 nucleotides, wherein some positions may be absent or this region is absent in its entirety
  See specification as filed for detailed description of substitutions and preferred embodiments
ggnnnnnnnnnnnnnnnnnnnnnnnnnnnnnnnnnnnnnnnnnnnnnnnnnnggnnnggnnnnnnnnnnnnnnnnnnnnnnnnnnnnnnnnnnnnnnnnnnnnnnnnnngg

SEQ ID NO: 704 - DNA, 111 bp, Artificial Sequence
  Description of Artificial Sequence: Synthetic oligonucleotide
  Description of Combined DNA/RNA Molecule: Synthetic oligonucleotide
  modified_base (3)..(52): Independently selected from a linker, any modified nucleotide or any unmodified nucleotide
  misc_feature (3)..(52): This region may encompass 1-50, 1-40, 1-30, 1-20, 1-15, 1-10 or 1-5 nucleotides, wherein some positions may be absent or this region is absent in its entirety
  modified_base (55)..(104): Independently selected from a linker, any modified nucleotide or any unmodified nucleotide
  misc_feature (55)..(104): This region may encompass 1-50, 1-40, 1-30, 1-20, 1-15, 1-10 or 1-5 nucleotides, wherein some positions may be absent or this region is absent in its entirety
  modified_base (107)..(109): Independently selected from U, T or a modified pyrimidine
  See specification as filed for detailed description of substitutions and preferred embodiments
ggnnnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnggnnngg

SEQ ID NO: 705 - DNA, 49 bp, Artificial Sequence
  Description of Artificial Sequence: Synthetic oligonucleotide
  Description of Combined DNA/RNA Molecule: Synthetic oligonucleotide
  modified_base (1)..(2): Independently selected from any modified pyrimidine
  modified_base (4)..(4): Independently selected from any modified pyrimidine
  modified_base (6)..(6): Independently selected from any modified pyrimidine
  modified_base (9)..(38): Independently selected from a linker, any modified nucleotide or any unmodified nucleotide
  misc_feature (9)..(38): This region may encompass 1-30, 1-20, 1-15, 1-10 or 1-5 nucleotides, wherein some positions may be absent or this region is absent in its entirety
  modified_base (41)..(41): Independently selected from any modified pyrimidine
  modified_base (49)..(49): Independently selected from any modified pyrimidine
  See specification as filed for detailed description of substitutions and preferred embodiments
nnangnarnnnnnnnnnnnnnnnnnnnnnnnnnnnnnnmgnaagscgrn

SEQ ID NO: 706 - DNA, 49 bp, Artificial Sequence
  Description of Artificial Sequence: Synthetic oligonucleotide
  Description of Combined DNA/RNA Molecule: Synthetic oligonucleotide
  modified_base (3)..(3): Independently selected from any modified pyrimidine
  modified_base (11)..(11): Independently selected from any modified pyrimidine
  modified_base (12)..(41): Independently selected from a linker, any modified nucleotide or any unmodified nucleotide
  misc_feature (12)..(41): This region may encompass 1-30, 1-20, 1-15, 1-10 or 1-5 nucleotides, wherein some positions may be absent or this region is absent in its entirety
  modified_base (42)..(43): Independently selected from any modified pyrimidine
  modified_base (45)..(45): Independently selected from any modified pyrimidine
  modified_base (47)..(47): Independently selected from any modified pyrimidine
  See specification as filed for detailed description of substitutions and preferred embodiments
mgnaagscgrnnnnnnnnnnnnnnnnnnnnnnnnnnnnnnnnnangnar

SEQ ID NO: 707 - protein, 6 aa, Artificial Sequence
  Description of Artificial Sequence: Synthetic 6xHis tag
HHHHHH

What is claimed is:

1. An aptamer that specifically binds IL-6, wherein the aptamer comprises a sequence selected from:

```
                                      (SEQ ID NO: 705)
5'-YXAXGYARQ_aMGYAAGSCGRY-3' (VI);
and
                                      (SEQ ID NO: 706)
5'-MGYAAGSCGRYQ_bYXAXGYAR-3' (VII);
``` wherein each Y is independently selected from a modified pyrimidine; each X is independently selected from a modified pyrimidine; M is selected from C and A; S is selected from C and G; each R is independently selected from G and A; each Q is independently selected from a linker, a modified nucleotide, and an unmodified nucleotide; a is 1 to 30; and / or b is 1 to 30.

2. The aptamer of claim 1, comprising the sequence:

```
                                      (SEQ ID NO: 701)
5'-GGGYXAXGYAGCL_bGZGCGYAAGGCGGY-3' (II);
``` wherein Z is selected from U, T, and a modified pyrimidine; each Y is independently selected from a modified pyrimidine; each X is independently selected from a modified pyrimidine; each L is independently selected from a linker, a modified nucleotide, and an unmodified nucleotide; b is 1 to 20.

3. The aptamer of claim 2, wherein the each Q or L is independently selected from a substituted or unsubstituted $C_2$-$C_{20}$ linker, an alkylene glycol, and a polyalkylene glycol.

4. The aptamer of claim 3, wherein each Q or L is independently selected from a substituted or unsubstituted $C_2$-$C_{20}$ linker, a 1,3-propane diol, a poly(1,3-propane diol) having from 2 to 100 1,3-propane diol units, an ethylene glycol, and a polyethylene glycol having from 2 to 100 ethylene glycol units.

5. The aptamer of claim 1 wherein each X is independently selected from an aromatic modified pyrimidine.

6. The aptamer of claim 1 wherein each Y is independently selected from the modified pyrimidines shown in FIG. 20 and FIG. 24.

7. The aptamer of claim 4 wherein each substituted or unsubstituted $C_2$-$C_{20}$ linker is a substituted or unsubstituted $C_2$-$C_8$ linker, a substituted or unsubstituted $C_2$-$C_6$ linker, a substituted or unsubstituted $C_2$-$C_5$ linker, a substituted or unsubstituted $C_2$-$C_4$ linker, or a substituted or unsubstituted $C_3$ linker.

8. The aptamer of claim 1 wherein each X is independently selected from:

5-(N-1-naphthylmethylcarboxyamide)-2'-deoxyuridine (NapdU), 5-(N-1-naphthylmethylcarboxyamide)-2'-O-methyluridine, 5-(N-1-naphthylmethylcarboxyamide)-2'-fluorouridine, 5-(N-2-naphthylmethylcarboxyamide)-2'-deoxyuridine (2NapdU), 5-(N-2-naphthylmethylcarboxyamide)-2'-O-methyluridine, 5-(N-2-naphthylmethylcarboxyamide)-2'-fluorouridine, 5-(N-1-naphthylethylcarboxyamide)-2'-deoxyuridine (NEdU), 5-(N-1-naphthylethylcarboxyamide)-2'-O-methyluridine, 5-(N-1-naphthylethylcarboxyamide)-2'-fluorouridine, 5-(N-2-naphthylethylcarboxyamide)-2'-deoxyuridine (2NEdU), 5-(N-2-naphthylethylcarboxyamide)-2'-O-methyluridine, 5-(N-2-naphthylethylcarboxyamide)-2'-fluorouridine, 5-(N-3-benzofuranylethylcarboxyamide)-2'-deoxyuridine (BFdU), 5-(N-3-benzofuranylethylcarboxyamide)-2'-O-methyluridine, 5-(N-3-benzofuranylethylcarboxyamide)-2'-fluorouridine, 5-(N-3-benzothiophenylethylcarboxyamide)-2'-deoxyuridine (BTdU), 5-(N-3-benzothiophenylethylcarboxyamide)-2'-O-methyluridine, and 5-(N-3-benzothiophenylethylcarboxyamide)-2'-fluorouridine.

9. A pharmaceutical composition comprising at least one aptamer of claim 1, or pharmaceutically acceptable salt thereof, and a pharmaceutically acceptable carrier.

10. A method of treating a disease or condition mediated by IL-6 comprising administering the pharmaceutical composition of claim 9.

11. The method of claim 10, wherein the disease or condition mediated by IL-6 is selected from an inflammatory disease, a malignant disease, an infection, and an autoimmune disease.

* * * * *